(12) United States Patent
Adam et al.

(10) Patent No.: US 12,275,798 B2
(45) Date of Patent: Apr. 15, 2025

(54) TRI-SPECIFIC BINDING MOLECULES

(71) Applicant: Boehringer Ingelheim International GmbH, Ingelheim am Rhein (DE)

(72) Inventors: Paul Adam, Vienna (AT); Stephen R. Comeau, Avon, NY (US); Philip Nicholas Gorman, Prospect, CT (US); Pankaj Gupta, Scarsdale, NY (US); Priyanka Gupta, Danbury, CT (US); Karl-Heinz Heider, Stockerau (AT); Srinath Kasturirangan, Brookfield, CT (US); Renate Konopitzky, Bad Voeslau (AT); Klaus-Peter Kuenkele, Langenbach (DE); Sandeep Kumar, Ridgefield, CT (US); Taneisha Ann-Tanara Mack, Southbury, CT (US); Elinborg Katrin Ostermann, Mauerbach (AT); Abdulsalam Shaaban, Ridgefield, CT (US); David Weismann, Maria Enzersdorf (AT); Andreas Wernitznig, Vienna (AT); David S. Young, New Milford, CT (US)

(73) Assignee: Boehringer Ingelheim International GmbH, Ingelheim am Rhein (DE)

( * ) Notice: Subject to any disclaimer, the term of this patent is extended or adjusted under 35 U.S.C. 154(b) by 87 days.

(21) Appl. No.: 17/840,655

(22) Filed: Jun. 15, 2022

(65) Prior Publication Data
US 2022/0411533 A1    Dec. 29, 2022

(30) Foreign Application Priority Data
Jun. 17, 2021 (EP) .................................. 21180033

(51) Int. Cl.
  *C07K 16/30* (2006.01)
  *A61P 35/00* (2006.01)
  *C07K 16/28* (2006.01)

(52) U.S. Cl.
CPC ............ *C07K 16/30* (2013.01); *A61P 35/00* (2018.01); *C07K 16/28* (2013.01); *C07K 16/2809* (2013.01); *C07K 16/2818* (2013.01); *C07K 16/2827* (2013.01); *C07K 2317/31* (2013.01); *C07K 2317/622* (2013.01); *C07K 2317/92* (2013.01); *C07K 2319/00* (2013.01)

(58) Field of Classification Search
CPC .... C07K 16/30; C07K 16/28; C07K 16/2809; C07K 16/2818; C07K 16/2827; C07K 2317/31; C07K 2317/622; C07K 2317/92; C07K 2319/00; C07K 2317/21; C07K 2317/24; C07K 2317/35; C07K 2317/64; C07K 2317/73; A61P 35/00
See application file for complete search history.

(56) References Cited

U.S. PATENT DOCUMENTS

| 4,766,980 A | 8/1988 | Engle |
| 5,731,168 A | 3/1998 | Carter et al. |
| 5,929,212 A | 7/1999 | Jolliffe et al. |
| 7,728,114 B2 | 6/2010 | Mach et al. |
| 9,782,478 B1 | 10/2017 | Blankenship et al. |
| 9,914,776 B2 | 3/2018 | Ast et al. |
| 10,066,015 B2 | 9/2018 | Zhukovsky et al. |
| 10,066,016 B2 | 9/2018 | Dubridge et al. |
| 10,174,124 B2 | 1/2019 | Chen et al. |
| 10,544,221 B2 | 1/2020 | Dubridge et al. |
| 2016/0145340 A1 | 5/2016 | Borges et al. |
| 2018/0118848 A1 | 5/2018 | Haber et al. |
| 2018/0326058 A1 | 11/2018 | Tsunenari et al. |
| 2019/0046655 A1 | 2/2019 | Arbele |
| 2021/0403562 A1 | 12/2021 | Freimoser-Grundschober et al. |

FOREIGN PATENT DOCUMENTS

| WO | 8801649 A1 | 3/1988 |
| WO | 0905144 A1 | 5/1990 |
| WO | 9117271 A1 | 11/1991 |
| WO | 9308829 A1 | 5/1993 |
| WO | 9404678 A1 | 3/1994 |
| WO | 9413804 A1 | 6/1994 |
| WO | 9429348 A2 | 12/1994 |
| WO | 9825971 A1 | 6/1998 |
| WO | 9848837 A1 | 11/1998 |
| WO | 0179258 A1 | 10/2001 |
| WO | 02056910 A1 | 7/2002 |
| WO | 03050531 A2 | 6/2003 |
| WO | 2004041865 A2 | 5/2004 |
| WO | 2004081026 A2 | 9/2004 |

(Continued)

OTHER PUBLICATIONS

Mariuzza (Annu. Rev. Biophys. Biophys. Chem., 16: 139-159, 1987).*
Nie, Biology drives the discovery of bispecific antibodies as innovatice therapeutics, Antibody Therapeutics, vol. 3, 2020, p. 18-62.
Blumel, Epitope distance to the target cell membrane and antigen size determine the potency of T cell mediated lysis by BiTE antibodies, Cancer Immunol., Immunotherapy, vol. 59, 2010, p. 1197-1209.

(Continued)

*Primary Examiner* — Nelson B Moseley, II
(74) *Attorney, Agent, or Firm* — Wendy M. Gombert

(57) ABSTRACT

The present invention relates to novel tri-specific binding molecules. The invention also relates to nucleic acids encoding such binding molecules; to methods for preparing such binding molecules; to host cells expressing or capable of expressing such binding molecules; to compositions comprising such binding molecules; and to uses of such binding molecules or such compositions, in particular for therapeutic purposes in the field of cancer diseases.

17 Claims, 33 Drawing Sheets
Specification includes a Sequence Listing.

(56) References Cited

FOREIGN PATENT DOCUMENTS

| WO | 2004106383 | A1 | 12/2004 |
|---|---|---|---|
| WO | 2006040153 | A2 | 4/2006 |
| WO | 2007003320 | A1 | 1/2007 |
| WO | 2007042309 | A2 | 4/2007 |
| WO | 2009089004 | A1 | 7/2009 |
| WO | 2010136172 | A1 | 12/2010 |
| WO | 2011090762 | A1 | 7/2011 |
| WO | 2014047231 | A1 | 3/2014 |
| WO | 2016187594 | A1 | 11/2016 |
| WO | 2017198741 | A1 | 11/2017 |
| WO | 2018201051 | A1 | 11/2018 |
| WO | 2018209298 | A1 | 11/2018 |
| WO | 2019075378 | A1 | 4/2019 |
| WO | 2021113748 | | 6/2021 |

OTHER PUBLICATIONS

Dickopf, Format and geometries togrther, Computational and Structural Biotech Journal, vol. 18, 2020, p. 1221-1227.
Roda-Navarro, Understanding the spatial Topology of Artifical Immunological Synapses, Frontiers in cell and Developmental Biology, vol. 10, 2020, 10 pages.
Rossi, Redirected T-cell Killing of solid cancers Targeted with an Anti-CD3/trop-2-bispecific antibody is enhanced in Combination with Interferon, Molevualr cancer therapeutics, vol. 10, 2014, 12 pages.
Suurs, A review of bispecific antibodies and antibody constructs in oncology and clinical challenges, Pharmacology, vol. 201, 2019, 17 pages.
Chen, Immunoglobulin Gamma-like Therapeutic Bispecific Antibody format for tumor therapy, Journal of Immunology research, vol. 2019, 2020, 13 pages.
Krah, Engineering bispecific antibodies with defined chain pairing, New Biotechnology, vol. 39, 2017, 7 pages.
Kebenko, A multicenter phase 1 study of solitomab, Oncoimmunology, vol. 7, 2018, 11 pages.
Brooks, The importance of Epitope Binning for Biological Drug Discovery, Current Drug Discovery Technologies, vol. 11, 2014, p. 109-112.
Amaral, Engineered Technologies and bioanalysis of multispecific antibody formats, Journal od Applied Bioanalysis, vol. 6, 2020, 26 pages.
Abdiche, High-Throughput Epitope Binning Assays on label free array-based biosensors can yield exquisite epitope discrimination that facilitates the selection of monoclonal antibodies with functional activity, PLOS, vol. 9, 2014, 16 pages.
Edelman, The covalent structure of the entire yG immunoglobulin molevule, Biochemistry, vol. 63, 1969, 8 pages.
Kellner, Modulating Cytotoxic Effector Functions by Fc Engineering to improve Cancer therapy, Tranfus Med Hemother., vol. 44, 2017, 10 pages.
Malmqvist, Surface plasmon resonance for detection and measurement of antibody-antigen affinity and kinetics, Current Opinion in Immunology, vol. 5, 1994, 5 pages.
Saunders, Conceptual Approaches to Modulating Antibody effector functions and Circulation half life, Frontiers in Immunology, vol. 10, 2019, 20 pages.
Hezareh, Effector function Activities of a panel of mutants of a nroadly neutralizing antibody against human immunodeficiency virus type 1, Journal od Virology, vol. 75, 2001, 8 pages.
Darling, Kinetic Exclusion Assay Technology, Abstract, Published online: Jan. 27, 2005, https:/doi.org.10.1089/adt.2004.2.647.
Karlin and Altschul, Applications and statistics for multiple high-scoring segments in molecular sequences, Proc. Natl. Acad. Sci, vol. 90, 1993, 5 pages.
Hollinger, Engineered antibody fragments and the rise of singel domains, Nature biotechnology, vol. 23, 2005, 11 pages.
Altschul, Basic Local Alighment Search Tool, J. Mol. Biol. vol. 215, 1990, 8 pages.
Nilvebrandt, Engineered autonomous human variable domains, Curr. pharm. Des., vol. 22, 2016, 27 pages.
Altschul, Gapped BLAST and PSI-BLAST: a new generation of protein database search programs, Nucleic acids research, vol. 25, 1997, 14 pages.
Singh, Selective targeting of the IL23 pathway: generation and characterization of a novel high-affinity humanized anti-IL23A antibody, mAbs, vol. 7, 2015 14 pages.
Higgins, Using CLUSTAL for multiple sequence alignments, Methods in Enzymology, vol. 266, 1996, 20 pages.
Pessano, The T3/T cell receptor complex, The EMBO journal, vol. 4, 1985, 8 pages.
Volkel, Optimized linker sequences for the expression of monomeric and dimeric bispecic single-chain diabodies, vol. 14, 2001, 9 pages.
Salmeron, A conformational epitope expressed upon association o CD-3 epsilon with either CD-3 delta or CD-3 gamma, Joural of Immunology, vol. 147, 1991, 7 pages.
Miller, Stability engineering of scFvs for the development of bispecific and multivalent antibodies, Protein Engineering, vol. 23, 2010, 9 pages.
Atwell, Stable heterodimers from remodeling the domain interface of a homodimer using a phage dispaly library, J. Mol. Biol., vol. 270, 10 pages.
Kugler, Stabliziation andhumanization of a single-chain Fv antibody fragment specific for human lymphocyte antigen CD19 by designed point mutations, Protein Engineering, vol. 22, 2009, 13 pages.
Millstein, Hybrid Hybridomas and their use in Immunohistochemistry, Pubmed, Abstract, https://www.ncbi.nlm.nih.gov.pubmed/6137772, 2020.
Srinivasan, Immunomodulatory Peptides fro IgSF Proteins, Current Proteins and Peptide Science, vol. 6, 2005, 12 pages.
Traunecker, Bispecific single chain molecules, The EMBO journal, vol. 10, 1991, p. 3655-3659.
Billetta, Chimeric Antibodies, Internaional Reviews of Immunology, vol. 10, 1991, 13 pages.
Reichmann, Reshaping human antibodies for therapy, vol. 332, 1988, 5 pages.
Brennan, Preparation of bispecific antibodies by chemical recombination of monoclonal immunoglobulin G1 fragments, downloaded from http://sciencemag.org on Jan. 7, 2020.
Kostelny, Formation of a bispecific antibody by the use of leucine zippers, vol. 148, 1992, 8 pages.
Liu, Fc Engineering for developing Therapeutic Bispecific Antibodies, Frontiers in immunology, vol. 8, 2017, 15 pages.
Moore, A robust heterodimeric Fc platform engineered for efficient development of bispecific antibodies, Methods, vol. 154, 2019, 13 pages.
Almagro, Antibodies modeling assessment, Proteins, 2011, 17 pages.
Maier, Assessment of fully automated antibody homology modeling protocols in molecular poperating environment, Proteins, 2014, 12 pages.
Goulet, Considerations for the design of antibody based therapeutics, J. Pharm sci., vol. 109, 2020, 74 pages.
Chothia and Lesk, Canonical Structures for the Hypervariable regions of Immunoglobulins, J. Mol. Biol., vol. 196, 1987, 17 pages.
Tiller, Advances in Antibody Design, Annu. Rev. Biomed. Eng., vol. 17., 2015, 31 pages.
LeFranc, IMGT unique numbering for immunoglobulin and T cell receptor variable domains and Ig superfamily V-like domains, Developmental and Comparitive Immunology, vol. 27, 2003, 23 pages.
Skerra, Alternative non-antibody scaffolds for molecular recognition, ScienceDirect, vol. 18, 2007, 10 pages.
North, A new clustering of antibody CDR loop conformations, J. Mol. Biol., vol. 406, 2011, 50 pages.

* cited by examiner

A)

B)

A)

B)

A)

B)

C)

A)

B)

A)

A (continued)

A (continued)

A (continued)

A (continued)

A (continued)

B (continued)

TRI-SPECIFIC BINDING MOLECULES

FIELD OF THE INVENTION

The present invention relates to novel tri-specific binding molecules. The invention also relates to nucleic acids encoding such binding molecules; to methods for preparing such binding molecules; to host cells expressing or capable of expressing such binding molecules; to compositions comprising such binding molecules; and to uses of such binding molecules or such compositions, in particular for therapeutic purposes in the field of cancer diseases.

BACKGROUND OF THE INVENTION

Cancer is a group of diseases commonly based on abnormal cell proliferation and the potential for cancerous cells to invade or spread throughout the body. It is a serious disease and a major cause of death globally.

Various methods of treatment have been used in an attempt to manage or in some cases treat cancer, including surgery, chemotherapy, radiation therapy and hormonal therapy. In addition, antibodies offer the potential to be powerful therapeutic agents for the treatment of cancer. Antibodies are designed to recognize and bind to specific proteins on the surface of cells, their target antigens. This binding can provoke a number of different biological responses, depending for example on the cell type expressing the target antigen, the function of the target antigen protein or the structure of the antibody itself.

Some antibodies, for example, bind to cancer cells directly and can, e.g., stop or reduce cell division of these cells by interfering with cellular pathways, thereby slowing or preventing abnormal cell proliferation. Alternatively, such cancer cell-targeting antibodies can also have drugs or radioactive particles attached, thereby delivering these therapeutics to the cancer cell to act independently of the cell's intrinsic pathways. A different approach from these cancer cell-targeted methods is based on antibodies that are able to induce the immune system to attack and kill cancer cells. This can either be achieved by redirecting immune cells, such as e.g. cytotoxic T cells, to the cancer cells or by directly influencing the activity of the immune system itself.

Although both the cancer cell-targeting approaches as well as the immune cell-redirecting approaches provide potent modes-of-action (MoA) for the treatment of cancer, they often rely on the expression of a cancer cell-specific marker, i.e. a target protein that is not or little expressed by non-cancerous cells. Such tumour-specific target proteins are rare and this scarcity remains a major drawback typically faced in the development of cancer-specific therapeutics.

While attempts to redirect immune cells to more broadly expressed lineage antigens have been made, the value of these therapies has been limited by toxicities caused by the expression of these antigens in certain normal tissues, such as for example the expression of Epcam in the gastrointestinal tract (Kebenko et al., Oncoimmunology 2018, Vol. 7, No. 8). While various approaches to reduce the toxicities related to off-site antigen expression are currently pursued, toxicities still remain dose-limiting for many compounds.

Thus, although there have been advances in the treatment of certain cancers in recent years and despite the fact that numerous different approaches are currently pursued, there is still a need to provide novel, therapeutically suitable compounds for the treatment of cancer. It is thus an object of the present invention to provide such pharmacologically active agents that can be used in the treatment of various cancer diseases.

In particular, it is an object of the invention to provide such pharmacologically active agents, compositions and/or methods of treatment that provide certain advantages compared to the agents, compositions and/or methods currently used and/or known in the art. These advantages include in vivo efficacy, improved therapeutic and pharmacological properties, less side effects, and other advantageous properties such as improved ease of preparation or reduced costs of goods, especially as compared to candidate drugs already known in the art.

This need is addressed by the embodiments provided herein.

BRIEF SUMMARY OF THE INVENTION

The present invention is based on the concept of combining three antigen binding sites within a single binding molecule, namely a first antigen binding site that binds specifically to trophoblast cell-surface antigen 2 (TROP2), a second antigen binding site that binds specifically to cadherin-17 (CDH17) and a third antigen binding sites that binds specifically to cluster of differentiation 3 (CD3). As discussed in more detail below, one advantage of the molecules of the invention is their low affinity, high avidity design that provides superior specificity to target cells.

Hence, a first aspect of the invention provides a binding molecule comprising: (a) at least one antigen binding site that binds specifically to trophoblast cell-surface antigen 2 (TROP2) with a Kd≥1 nM, (b) at least one antigen binding site that binds specifically to cadherin-17 (CDH17), wherein the at least one antigen binding site that binds specifically to CDH17 is selected from the group consisting of antigen binding sites (i) to (ii): (i) an antigen binding site comprising heavy chain CDRs comprising the amino acid sequences of SEQ ID NO.:32 (CDR1), SEQ ID NO.:33 (CDR2) and SEQ ID NO.:34 (CDR3) and light chain CDRs comprising the amino acid sequences of SEQ ID NO.:35 (CDR1), SEQ ID NO.:36 (CDR2) and SEQ ID NO.:37 (CDR3); and (ii) an antigen binding site comprising heavy chain CDRs comprising the amino acid sequences of SEQ ID NO.:32 (CDR1), SEQ ID NO.:38 (CDR2) and SEQ ID NO.:34 (CDR3) and light chain CDRs comprising the amino acid sequences of SEQ ID NO.:39 (CDR1), SEQ ID NO.:40 (CDR2) and SEQ ID NO.:37 (CDR3), and (c) at least one antigen binding site that binds specifically to cluster of differentiation 3 (CD3).

In a preferred embodiment of the binding molecule of the invention, the at least one antigen binding site that binds specifically to TROP2 is selected from the group consisting of antigen binding sites (i) to (vi):
  (i) an antigen binding site comprising heavy chain CDRs comprising the amino acid sequences of SEQ ID NO.:1 (CDR1), SEQ ID NO.:2 (CDR2) and SEQ ID NO.:3 (CDR3) and light chain CDRs comprising the amino acid sequences of SEQ ID NO.:4 (CDR1), SEQ ID NO.:5 (CDR2) and SEQ ID NO.:6 (CDR3);
  (ii) an antigen binding site comprising heavy chain CDRs comprising the amino acid sequences of SEQ ID NO.:7 (CDR1), SEQ ID NO.:8 (CDR2) and SEQ ID NO.:9 (CDR3) and light chain CDRs comprising the amino acid sequences of SEQ ID NO.:10 (CDR1), SEQ ID NO.:11 (CDR2) and SEQ ID NO.:12 (CDR3);
  (iii) an antigen binding site comprising heavy chain CDRs comprising the amino acid sequences of SEQ ID NO.:

13 (CDR1), SEQ ID NO.:14 (CDR2) and SEQ ID NO.:15 (CDR3) and light chain CDRs comprising the amino acid sequences of SEQ ID NO.:16 (CDR1), SEQ ID NO.:17 (CDR2) and SEQ ID NO.:18 (CDR3);

(iv) an antigen binding site comprising heavy chain CDRs comprising the amino acid sequences of SEQ ID NO.: 13 (CDR1), SEQ ID NO.:19 (CDR2) and SEQ ID NO.:15 (CDR3) and light chain CDRs comprising the amino acid sequences of SEQ ID NO.:20 (CDR1), SEQ ID NO.:17 (CDR2) and SEQ ID NO.:18 (CDR3);

(v) an antigen binding site comprising heavy chain CDRs comprising the amino acid sequences of SEQ ID NO.: 21 (CDR1), SEQ ID NO.:22 (CDR2) and SEQ ID NO.:23 (CDR3) and light chain CDRs comprising the amino acid sequences of SEQ ID NO.:24 (CDR1), SEQ ID NO.:25 (CDR2) and SEQ ID NO.:26 (CDR3); and (vi) an antigen binding site comprising heavy chain CDRs comprising the amino acid sequences of SEQ ID NO.: 27 (CDR1), SEQ ID NO.:28 (CDR2) and SEQ ID NO.:29 (CDR3) and light chain CDRs comprising the amino acid sequences of SEQ ID NO.:30 (CDR1), SEQ ID NO.:25 (CDR2) and SEQ ID NO.:31 (CDR3).

In a preferred embodiment of the binding molecule of the invention the at least one antigen binding site that binds specifically to TROP2 is selected from the group consisting of antigen binding sites (i) to (xii):

(i) an antigen binding site comprising an immunoglobulin heavy chain variable domain comprising the amino acid sequence of SEQ ID NO:83 and an immunoglobulin light chain variable domain comprising the amino acid sequence of SEQ ID NO:84;

(ii) an antigen binding site comprising an immunoglobulin heavy chain variable domain comprising the amino acid sequence of SEQ ID NO:85 and an immunoglobulin light chain variable domain comprising the amino acid sequence of SEQ ID NO:86;

(iii) an antigen binding site comprising an immunoglobulin heavy chain variable domain comprising the amino acid sequence of SEQ ID NO:87 and an immunoglobulin light chain variable domain comprising the amino acid sequence of SEQ ID NO:88;

(iv) an antigen binding site comprising an immunoglobulin heavy chain variable domain comprising the amino acid sequence of SEQ ID NO:89 and an immunoglobulin light chain variable domain comprising the amino acid sequence of SEQ ID NO:90;

(v) an antigen binding site comprising an immunoglobulin heavy chain variable domain comprising the amino acid sequence of SEQ ID NO:91 and an immunoglobulin light chain variable domain comprising the amino acid sequence of SEQ ID NO:92;

(vi) an antigen binding site comprising an immunoglobulin heavy chain variable domain comprising the amino acid sequence of SEQ ID NO:93 and an immunoglobulin light chain variable domain comprising the amino acid sequence of SEQ ID NO:94;

(vii) an antigen binding site comprising an immunoglobulin heavy chain variable domain comprising the amino acid sequence of SEQ ID NO:95 and an immunoglobulin light chain variable domain comprising the amino acid sequence of SEQ ID NO:94;

(viii) an antigen binding site comprising an immunoglobulin heavy chain variable domain comprising the amino acid sequence of SEQ ID NO:95 and an immunoglobulin light chain variable domain comprising the amino acid sequence of SEQ ID NO:96;

(ix) an antigen binding site comprising an immunoglobulin heavy chain variable domain comprising the amino acid sequence of SEQ ID NO:95 and an immunoglobulin light chain variable domain comprising the amino acid sequence of SEQ ID NO:97;

(x) an antigen binding site comprising an immunoglobulin heavy chain variable domain comprising the amino acid sequence of SEQ ID NO:98 and an immunoglobulin light chain variable domain comprising the amino acid sequence of SEQ ID NO:97;

(xi) an antigen binding site comprising an immunoglobulin heavy chain variable domain comprising the amino acid sequence of SEQ ID NO:95 and an immunoglobulin light chain variable domain comprising the amino acid sequence of SEQ ID NO:99; or (xii) an antigen binding site comprising an immunoglobulin heavy chain variable domain comprising the amino acid sequence of SEQ ID NO:98 and an immunoglobulin light chain variable domain comprising the amino acid sequence of SEQ ID NO:96.

In a preferred embodiment of the binding molecule of the invention, the at least one antigen binding site that binds specifically to CDH17 is selected from the group consisting of antigen binding sites (i) to (ii):

(i) an antigen binding site comprising an immunoglobulin heavy chain variable domain comprising the amino acid sequence of SEQ ID NO:100 and an immunoglobulin light chain variable domain comprising the amino acid sequence of SEQ ID NO:101; and (ii) an antigen binding site comprising an immunoglobulin heavy chain variable domain comprising the amino acid sequence of SEQ ID NO:102 and an immunoglobulin light chain variable domain comprising the amino acid sequence of SEQ ID NO:103.

In a preferred embodiment of the binding molecule of the invention, the at least one antigen binding site that binds specifically to CD3 is selected from the group consisting of antigen binding sites (i) to (xxxi):

(i) an antigen binding site comprising heavy chain CDRs comprising the amino acid sequences of SEQ ID NO.: 41 (CDR1), SEQ ID NO.:42 (CDR2) and SEQ ID NO.:43 (CDR3) and light chain CDRs comprising the amino acid sequences of SEQ ID NO.:44 (CDR1), SEQ ID NO.:45 (CDR2) and SEQ ID NO.:47 (CDR3);

(ii) an antigen binding site comprising heavy chain CDRs comprising the amino acid sequences of SEQ ID NO.: 41 (CDR1), SEQ ID NO.:42 (CDR2) and SEQ ID NO.:43 (CDR3) and light chain CDRs comprising the amino acid sequences of SEQ ID NO.:44 (CDR1), SEQ ID NO.:45 (CDR2) and SEQ ID NO.:46 (CDR3);

(iii) an antigen binding site comprising heavy chain CDRs comprising the amino acid sequences of SEQ ID NO.: 41 (CDR1), SEQ ID NO.:48 (CDR2) and SEQ ID NO.:43 (CDR3) and light chain CDRs comprising the amino acid sequences of SEQ ID NO.:44 (CDR1), SEQ ID NO.:45 (CDR2) and SEQ ID NO.:47 (CDR3);

(iv) an antigen binding site comprising heavy chain CDRs comprising the amino acid sequences of SEQ ID NO.: 41 (CDR1), SEQ ID NO.:42 (CDR2) and SEQ ID NO.:49 (CDR3) and light chain CDRs comprising the amino acid sequences of SEQ ID NO.:50 (CDR1), SEQ ID NO.:45 (CDR2) and SEQ ID NO.:51 (CDR3);

(v) an antigen binding site comprising heavy chain CDRs comprising the amino acid sequences of SEQ ID NO.: 41 (CDR1), SEQ ID NO.:42 (CDR2) and SEQ ID NO.:43 (CDR3) and light chain CDRs comprising the amino acid sequences of SEQ ID NO.:44 (CDR1), SEQ ID NO.:52 (CDR2) and SEQ ID NO.:47 (CDR3);
(vi) an antigen binding site comprising heavy chain CDRs comprising the amino acid sequences of SEQ ID NO.: 41 (CDR1), SEQ ID NO.:42 (CDR2) and SEQ ID NO.:49 (CDR3) and light chain CDRs comprising the amino acid sequences of SEQ ID NO.:44 (CDR1), SEQ ID NO.:52 (CDR2) and SEQ ID NO.:47 (CDR3);
(vii) an antigen binding site comprising heavy chain CDRs comprising the amino acid sequences of SEQ ID NO.:41 (CDR1), SEQ ID NO.:42 (CDR2) and SEQ ID NO.:43 (CDR3) and light chain CDRs comprising the amino acid sequences of SEQ ID NO.:53 (CDR1), SEQ ID NO.:52 (CDR2) and SEQ ID NO.:47 (CDR3);
(viii) an antigen binding site comprising heavy chain CDRs comprising the amino acid sequences of SEQ ID NO.:41 (CDR1), SEQ ID NO.:48 (CDR2) and SEQ ID NO.:54 (CDR3) and light chain CDRs comprising the amino acid sequences of SEQ ID NO.:55 (CDR1), SEQ ID NO.:45 (CDR2) and SEQ ID NO.:51 (CDR3);
(ix) an antigen binding site comprising heavy chain CDRs comprising the amino acid sequences of SEQ ID NO.: 41 (CDR1), SEQ ID NO.:48 (CDR2) and SEQ ID NO.:54 (CDR3) and light chain CDRs comprising the amino acid sequences of SEQ ID NO.:56 (CDR1), SEQ ID NO.:52 (CDR2) and SEQ ID NO.:51 (CDR3);
(x) an antigen binding site comprising heavy chain CDRs comprising the amino acid sequences of SEQ ID NO.: 41 (CDR1), SEQ ID NO.:48 (CDR2) and SEQ ID NO.:54 (CDR3) and light chain CDRs comprising the amino acid sequences of SEQ ID NO.:57 (CDR1), SEQ ID NO.:45 (CDR2) and SEQ ID NO.:51 (CDR3);
(xi) an antigen binding site comprising heavy chain CDRs comprising the amino acid sequences of SEQ ID NO.: 41 (CDR1), SEQ ID NO.:58 (CDR2) and SEQ ID NO.:59 (CDR3) and light chain CDRs comprising the amino acid sequences of SEQ ID NO.:60 (CDR1), SEQ ID NO.:45 (CDR2) and SEQ ID NO.:51 (CDR3);
(xii) an antigen binding site comprising heavy chain CDRs comprising the amino acid sequences of SEQ ID NO.:41 (CDR1), SEQ ID NO.:42 (CDR2) and SEQ ID NO.:43 (CDR3) and light chain CDRs comprising the amino acid sequences of SEQ ID NO.:61 (CDR1), SEQ ID NO.:52 (CDR2) and SEQ ID NO.:51 (CDR3);
(xiii) an antigen binding site comprising heavy chain CDRs comprising the amino acid sequences of SEQ ID NO.:41 (CDR1), SEQ ID NO.:62 (CDR2) and SEQ ID NO.:54 (CDR3) and light chain CDRs comprising the amino acid sequences of SEQ ID NO.:57 (CDR1), SEQ ID NO.:45 (CDR2) and SEQ ID NO.:51 (CDR3);
(xiv) an antigen binding site comprising heavy chain CDRs comprising the amino acid sequences of SEQ ID NO.:41 (CDR1), SEQ ID NO.:63 (CDR2) and SEQ ID NO.:54 (CDR3) and light chain CDRs comprising the amino acid sequences of SEQ ID NO.:56 (CDR1), SEQ ID NO.:45 (CDR2) and SEQ ID NO.:51 (CDR3);
(xv) an antigen binding site comprising heavy chain CDRs comprising the amino acid sequences of SEQ ID NO.:41 (CDR1), SEQ ID NO.:42 (CDR2) and SEQ ID NO.:43 (CDR3) and light chain CDRs comprising the amino acid sequences of SEQ ID NO.:61 (CDR1), SEQ ID NO.:45 (CDR2) and SEQ ID NO.:51 (CDR3);
(xvi) an antigen binding site comprising heavy chain CDRs comprising the amino acid sequences of SEQ ID NO.:41 (CDR1), SEQ ID NO.:42 (CDR2) and SEQ ID NO.:43 (CDR3) and light chain CDRs comprising the amino acid sequences of SEQ ID NO.:57 (CDR1), SEQ ID NO.:52 (CDR2) and SEQ ID NO.:51 (CDR3);
(xvii) an antigen binding site comprising heavy chain CDRs comprising the amino acid sequences of SEQ ID NO.:82 (CDR1), SEQ ID NO.:64 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);
(xviii) an antigen binding site comprising heavy chain CDRs comprising the amino acid sequences of SEQ ID NO.:82 (CDR1), SEQ ID NO.:69 (CDR2) and SEQ ID NO.:70 (CDR3) and light chain CDRs comprising the amino acid sequences of SEQ ID NO.:66 (CDR1), SEQ ID NO.:67 (CDR2) and SEQ ID NO.:68 (CDR3);
(xix) an antigen binding site comprising heavy chain CDRs comprising the amino acid sequences of SEQ ID NO.:82 (CDR1), SEQ ID NO.:72 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);
(xx) an antigen binding site comprising heavy chain CDRs comprising the amino acid sequences of SEQ ID NO.:82 (CDR1), SEQ ID NO.:73 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);
(xxi) an antigen binding site comprising heavy chain CDRs comprising the amino acid sequences of SEQ ID NO.:82 (CDR1), SEQ ID NO.:74 (CDR2) and SEQ ID NO.:65 (CDR3) and light chain CDRs comprising the amino acid sequences of SEQ ID NO.:71 (CDR1), SEQ ID NO.:67 (CDR2) and SEQ ID NO.:68 (CDR3);
(xxii) an antigen binding site comprising heavy chain CDRs comprising the amino acid sequences of SEQ ID NO.:82 (CDR1), SEQ ID NO.:73 (CDR2) and SEQ ID NO.:70 (CDR3) and light chain CDRs comprising the amino acid sequences of SEQ ID NO.:71 (CDR1), SEQ ID NO.:67 (CDR2) and SEQ ID NO.:68 (CDR3);
(xxiii) an antigen binding site comprising heavy chain CDRs comprising the amino acid sequences of SEQ ID NO.:82 (CDR1), SEQ ID NO.:75 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);
(xxiv) an antigen binding site comprising heavy chain CDRs comprising the amino acid sequences of SEQ ID NO.:82 (CDR1), SEQ ID NO.:69 (CDR2) and SEQ ID NO.:65 (CDR3) and light chain CDRs comprising the amino acid sequences of SEQ ID NO.:71 (CDR1), SEQ ID NO.:67 (CDR2) and SEQ ID NO.:68 (CDR3);
(xxv) an antigen binding site comprising heavy chain CDRs comprising the amino acid sequences of SEQ ID NO.:82 (CDR1), SEQ ID NO.:76 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);
(xxvi) an antigen binding site comprising heavy chain CDRs comprising the amino acid sequences of SEQ ID NO.:82 (CDR1), SEQ ID NO.:77 (CDR2) and SEQ ID NO.:65 (CDR3) and light chain CDRs comprising the amino acid sequences of SEQ ID NO.:71 (CDR1), SEQ ID NO.:67 (CDR2) and SEQ ID NO.:68 (CDR3);
(xxvii) an antigen binding site comprising heavy chain CDRs comprising the amino acid sequences of SEQ ID NO.:82 (CDR1), SEQ ID NO.:78 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);

(xxviii) an antigen binding site comprising heavy chain CDRs comprising the amino acid sequences of SEQ ID NO.:82 (CDR1), SEQ ID NO.:79 (CDR2) and SEQ ID NO.:65 (CDR3) and light chain CDRs comprising the amino acid sequences of SEQ ID NO.:80 (CDR1), SEQ ID NO.:67 (CDR2) and SEQ ID NO.:68 (CDR3);

(xxix) an antigen binding site comprising heavy chain CDRs comprising the amino acid sequences of SEQ ID NO.:82 (CDR1), SEQ ID NO.:81 (CDR2) and SEQ ID NO.:70 (CDR3) and light chain CDRs comprising the amino acid sequences of SEQ ID NO.:66 (CDR1), SEQ ID NO.:67 (CDR2) and SEQ ID NO.:68 (CDR3);

(xxx) an antigen binding site comprising heavy chain CDRs comprising the amino acid sequences of SEQ ID NO.:82 (CDR1), SEQ ID NO.:79 (CDR2) and SEQ ID NO.:65 (CDR3) and light chain CDRs comprising the amino acid sequences of SEQ ID NO.:80 (CDR1), SEQ ID NO.:67 (CDR2) and SEQ ID NO.:68 (CDR3); and (xxxi) an antigen binding site comprising heavy chain CDRs comprising the amino acid sequences of SEQ ID NO.:82 (CDR1), SEQ ID NO.:81 (CDR2) and SEQ ID NO.:70 (CDR3) and light chain CDRs comprising the amino acid sequences of SEQ ID NO.:66 (CDR1), SEQ ID NO.:67 (CDR2) and SEQ ID NO.:68 (CDR3).

In a preferred embodiment of the binding molecule of the invention, the at least one antigen binding site that binds specifically to CD3 is selected from the group consisting of antigen binding sites (i) to (xvi):

(i) an antigen binding site comprising an immunoglobulin heavy chain variable domain comprising the amino acid sequence of SEQ ID NO:104 and an immunoglobulin light chain variable domain comprising an amino acid sequence selected from the group consisting of SEQ ID NO:105, SEQ ID NO:106, SEQ ID NO:107, SEQ ID NO:109, SEQ ID NO:114, SEQ ID NO:115, SEQ ID NO:116, SEQ ID NO:117, SEQ ID NO:120, SEQ ID NO:121, SEQ ID NO:123, and SEQ ID NO:129;

(ii) an antigen binding site comprising an immunoglobulin heavy chain variable domain comprising the amino acid sequence of SEQ ID NO:110 and an immunoglobulin light chain variable domain comprising the amino acid sequence of SEQ ID NO:111;

(iii) an antigen binding site comprising an immunoglobulin heavy chain variable domain comprising the amino acid sequence of SEQ ID NO:112 and an immunoglobulin light chain variable domain comprising the amino acid sequence of SEQ ID NO:113;

(iv) an antigen binding site comprising an immunoglobulin heavy chain variable domain comprising the amino acid sequence of SEQ ID NO:118 and an immunoglobulin light chain variable domain comprising an amino acid sequence selected from the group consisting of SEQ ID NO:119 and SEQ ID NO:122;

(v) an antigen binding site comprising an immunoglobulin heavy chain variable domain comprising the amino acid sequence of SEQ ID NO:124 and an immunoglobulin light chain variable domain comprising an amino acid sequence selected from the group consisting of SEQ ID NO:125, SEQ ID NO:126 and SEQ ID NO:127;

(v) an antigen binding site comprising an immunoglobulin heavy chain variable domain comprising an amino acid sequence selected from the group consisting of SEQ ID NO:128 and SEQ ID NO:130 and an immunoglobulin light chain variable domain comprising an amino acid sequence of SEQ ID NO:127;

(vi) an antigen binding site comprising an immunoglobulin heavy chain variable domain comprising the amino acid sequence of SEQ ID NO:131 and an immunoglobulin light chain variable domain comprising the amino acid sequence of SEQ ID NO:132;

(vii) an antigen binding site comprising an immunoglobulin heavy chain variable domain comprising the amino acid sequence of SEQ ID NO:133 and an immunoglobulin light chain variable domain comprising an amino acid sequence selected from the group consisting of SEQ ID NO:134 and SEQ ID NO:135;

(viii) an antigen binding site comprising an immunoglobulin heavy chain variable domain comprising the amino acid sequence of SEQ ID NO:136 and an immunoglobulin light chain variable domain comprising the amino acid sequence of SEQ ID NO:137;

(ix) an antigen binding site comprising an immunoglobulin heavy chain variable domain comprising an amino acid sequence selected from the group consisting of SEQ ID NO:138 and SEQ ID NO: 156 and an immunoglobulin light chain variable domain comprising the amino acid sequence of SEQ ID NO:139;

(x) an antigen binding site comprising an immunoglobulin heavy chain variable domain comprising an amino acid sequence selected from the group consisting of SEQ ID NO:140, SEQ ID NO:142, SEQ ID NO:143 and SEQ ID NO:161 and an immunoglobulin light chain variable domain comprising an amino acid sequence of SEQ ID NO:141;

(xi) an antigen binding site comprising an immunoglobulin heavy chain variable domain comprising an amino acid sequence selected from the group consisting of SEQ ID NO:144 and SEQ ID NO:146 and an immunoglobulin light chain variable domain comprising an amino acid sequence of SEQ ID NO:145;

(xii) an antigen binding site comprising an immunoglobulin heavy chain variable domain comprising an amino acid sequence selected from the group consisting of SEQ ID NO:147, SEQ ID NO:151, SEQ ID NO:153 and SEQ ID NO:162 and an immunoglobulin light chain variable domain comprising an amino acid sequence of SEQ ID NO:148;

(xiii) an antigen binding site comprising an immunoglobulin heavy chain variable domain comprising an amino acid sequence selected from the group consisting of SEQ ID NO:149 and SEQ ID NO:152 and an immunoglobulin light chain variable domain comprising an amino acid sequence of SEQ ID NO:150;

(xiv) an antigen binding site comprising an immunoglobulin heavy chain variable domain comprising the amino acid sequence of SEQ ID NO:154 and an immunoglobulin light chain variable domain comprising the amino acid sequence of SEQ ID NO:155;

(xv) an antigen binding site comprising an immunoglobulin heavy chain variable domain comprising the amino acid sequence of SEQ ID NO:157 and an immunoglobulin light chain variable domain comprising the amino acid sequence of SEQ ID NO:158; and (xvi) an antigen binding site comprising an immunoglobulin heavy chain variable domain comprising the amino acid sequence of SEQ ID NO:159 and an immunoglobulin light chain variable domain comprising the amino acid sequence of SEQ ID NO:160.

In a preferred embodiment of the binding molecule of the invention, the binding molecule is a modified immunoglobulin (Ig) molecule, preferably a modified IgG molecule, wherein said at least one antigen binding site that specifically binds to TROP2 and said at least one antigen binding site that specifically binds to CDH17 reside in the variable regions of said Ig molecule, and wherein said at least one antigen binding site that binds specifically to CD3 is a scFv fused to said TROP2-CDH17-specific Ig molecule.

In a preferred embodiment of the binding molecule of the invention, the scFv is fused to the C-terminus of the heavy chain of the Ig molecule, preferably to the heavy chain of the part of the Ig molecule that comprises the at least one antigen binding site that specifically binds to CDH17.

In a preferred embodiment of the binding molecule of the invention, the binding molecule comprises: (a) a first immunoglobulin light chain and immunoglobulin heavy chain combination selected from (a-i) to (a-xii), preferably linked together by a peptide linker:
- (a-i) an immunoglobulin light chain comprising the amino acid sequence of SEQ ID NO:169 and an immunoglobulin heavy chain comprising the amino acid sequence of SEQ ID NO:170;
- (a-ii) an immunoglobulin light chain comprising the amino acid sequence of SEQ ID NO:171 and an immunoglobulin heavy chain comprising the amino acid sequence of SEQ ID NO:172;
- (a-iii) an immunoglobulin light chain comprising the amino acid sequence of SEQ ID NO:173 and an immunoglobulin heavy chain comprising the amino acid sequence of SEQ ID NO:174;
- (a-iv) an immunoglobulin light chain comprising the amino acid sequence of SEQ ID NO:175 and an immunoglobulin heavy chain comprising the amino acid sequence of SEQ ID NO:176;
- (a-v) an immunoglobulin light chain comprising the amino acid sequence of SEQ ID NO:177 and an immunoglobulin heavy chain comprising the amino acid sequence of SEQ ID NO:178;
- (a-vi) an immunoglobulin light chain comprising the amino acid sequence of SEQ ID NO:179 and an immunoglobulin heavy chain comprising the amino acid sequence of SEQ ID NO:180;
- (a-vii) an immunoglobulin light chain comprising the amino acid sequence of SEQ ID NO:181 and an immunoglobulin heavy chain comprising the amino acid sequence of SEQ ID NO:182;
- (a-viii) an immunoglobulin light chain comprising the amino acid sequence of SEQ ID NO:183 and an immunoglobulin heavy chain comprising the amino acid sequence of SEQ ID NO:184;
- (a-ix) an immunoglobulin light chain comprising the amino acid sequence of SEQ ID NO:185 and an immunoglobulin heavy chain comprising the amino acid sequence of SEQ ID NO:186;
- (a-x) an immunoglobulin light chain comprising the amino acid sequence of SEQ ID NO:187 and an immunoglobulin heavy chain comprising the amino acid sequence of SEQ ID NO:188;
- (a-xi) an immunoglobulin light chain comprising the amino acid sequence of SEQ ID NO:189 and an immunoglobulin heavy chain comprising the amino acid sequence of SEQ ID NO:190; or
- (a-xii) an immunoglobulin light chain comprising the amino acid sequence of SEQ ID NO:191 and an immunoglobulin heavy chain comprising the amino acid sequence of SEQ ID NO:192;

and (b) a second immunoglobulin heavy chain and immunoglobulin light chain combination selected from (b-i) to (b-ii), preferably linked together by a peptide-linker:
- (b-i) an immunoglobulin light chain comprising the amino acid sequence of SEQ ID NO:196 and an immunoglobulin heavy chain comprising the amino acid sequence of SEQ ID NO:197; or
- (b-ii) an immunoglobulin heavy chain comprising the amino acid sequence of SEQ ID NO:198 and an immunoglobulin light chain comprising the amino acid sequence of SEQ ID NO:199;

and (c) a single-chain variable fragment (scFv) comprising an amino acid sequence selected from the group consisting of SEQ ID NOs: 222 to 264, preferably linked to the C-terminus of the immunoglobulin heavy chain of said second immunoglobulin heavy chain and immunoglobulin light chain combination.

In a preferred embodiment of the binding molecule of the invention the binding molecule comprises or consists of:
- (a-i) the amino acid sequence of SEQ ID NO.:200 and the amino acid sequence of SEQ ID NO.:267;
- (a-ii) the amino acid sequence of SEQ ID NO.:207 and the amino acid sequence of SEQ ID NO.:267;
- (a-iii) the amino acid sequence of SEQ ID NO.:208 and the amino acid sequence of SEQ ID NO.:267;
- (a-iv) the amino acid sequence of SEQ ID NO.:209 and the amino acid sequence of SEQ ID NO.:267;
- (a-v) the amino acid sequence of SEQ ID NO.:210 and the amino acid sequence of SEQ ID NO.:267;
- (a-vi) the amino acid sequence of SEQ ID NO.:211 and the amino acid sequence of SEQ ID NO.:267;
- (a-vii) the amino acid sequence of SEQ ID NO.:212 and the amino acid sequence of SEQ ID NO.:267;
- (a-viii) the amino acid sequence of SEQ ID NO.:213 and the amino acid sequence of SEQ ID NO.:267;
- (a-ix) the amino acid sequence of SEQ ID NO.:214 and the amino acid sequence of SEQ ID NO.:267;
- (a-x) the amino acid sequence of SEQ ID NO.:215 and the amino acid sequence of SEQ ID NO.:267;
- (a-xi) the amino acid sequence of SEQ ID NO.:216 and the amino acid sequence of SEQ ID NO.:267;
- (a-xii) the amino acid sequence of SEQ ID NO.:217 and the amino acid sequence of SEQ ID NO.:267;
- (b-i) the amino acid sequence of SEQ ID NO.:200 and the amino acid sequence of SEQ ID NO.:268;
- (b-ii) the amino acid sequence of SEQ ID NO.:207 and the amino acid sequence of SEQ ID NO.:268;
- (b-iii) the amino acid sequence of SEQ ID NO.:208 and the amino acid sequence of SEQ ID NO.:268;
- (b-iv) the amino acid sequence of SEQ ID NO.:209 and the amino acid sequence of SEQ ID NO.:268;
- (b-v) the amino acid sequence of SEQ ID NO.:210 and the amino acid sequence of SEQ ID NO.:268;
- (b-vi) the amino acid sequence of SEQ ID NO.:211 and the amino acid sequence of SEQ ID NO.:268;
- (b-vii) the amino acid sequence of SEQ ID NO.:212 and the amino acid sequence of SEQ ID NO.:268;
- (b-viii) the amino acid sequence of SEQ ID NO.:213 and the amino acid sequence of SEQ ID NO.:268;
- (b-ix) the amino acid sequence of SEQ ID NO.:214 and the amino acid sequence of SEQ ID NO.:268;
- (b-x) the amino acid sequence of SEQ ID NO.:215 and the amino acid sequence of SEQ ID NO.:268;
- (b-xi) the amino acid sequence of SEQ ID NO.:216 and the amino acid sequence of SEQ ID NO.:268;
- (b-xii) the amino acid sequence of SEQ ID NO.:217 and the amino acid sequence of SEQ ID NO.:268;

(c-i) the amino acid sequence of SEQ ID NO.:200 and the amino acid sequence of SEQ ID NO.:269;
(c-ii) the amino acid sequence of SEQ ID NO.:207 and the amino acid sequence of SEQ ID NO.:269;
(c-iii) the amino acid sequence of SEQ ID NO.:208 and the amino acid sequence of SEQ ID NO.:269;
(c-iv) the amino acid sequence of SEQ ID NO.:209 and the amino acid sequence of SEQ ID NO.:269;
(c-v) the amino acid sequence of SEQ ID NO.:210 and the amino acid sequence of SEQ ID NO.:269;
(c-vi) the amino acid sequence of SEQ ID NO.:211 and the amino acid sequence of SEQ ID NO.:269;
(c-vii) the amino acid sequence of SEQ ID NO.:212 and the amino acid sequence of SEQ ID NO.:269;
(c-viii) the amino acid sequence of SEQ ID NO.:213 and the amino acid sequence of SEQ ID NO.:269;
(c-ix) the amino acid sequence of SEQ ID NO.:214 and the amino acid sequence of SEQ ID NO.:269;
(c-x) the amino acid sequence of SEQ ID NO.:215 and the amino acid sequence of SEQ ID NO.:269;
(c-xi) the amino acid sequence of SEQ ID NO.:216 and the amino acid sequence of SEQ ID NO.:269;
(c-xii) the amino acid sequence of SEQ ID NO.:217 and the amino acid sequence of SEQ ID NO.:269;
(d-i) the amino acid sequence of SEQ ID NO.:200 and the amino acid sequence of SEQ ID NO.:270;
(d-ii) the amino acid sequence of SEQ ID NO.:207 and the amino acid sequence of SEQ ID NO.:270;
(d-iii) the amino acid sequence of SEQ ID NO.:208 and the amino acid sequence of SEQ ID NO.:270;
(d-iv) the amino acid sequence of SEQ ID NO.:209 and the amino acid sequence of SEQ ID NO.:270;
(d-v) the amino acid sequence of SEQ ID NO.:210 and the amino acid sequence of SEQ ID NO.:270;
(d-vi) the amino acid sequence of SEQ ID NO.:211 and the amino acid sequence of SEQ ID NO.:270;
(d-vii) the amino acid sequence of SEQ ID NO.:212 and the amino acid sequence of SEQ ID NO.:270;
(d-viii) the amino acid sequence of SEQ ID NO.:213 and the amino acid sequence of SEQ ID NO.:270;
(d-ix) the amino acid sequence of SEQ ID NO.:214 and the amino acid sequence of SEQ ID NO.:270;
(d-x) the amino acid sequence of SEQ ID NO.:215 and the amino acid sequence of SEQ ID NO.:270;
(d-xi) the amino acid sequence of SEQ ID NO.:216 and the amino acid sequence of SEQ ID NO.:270;
(d-xii) the amino acid sequence of SEQ ID NO.:217 and the amino acid sequence of SEQ ID NO.:270;
(e-i) the amino acid sequence of SEQ ID NO.:200 and the amino acid sequence of SEQ ID NO.:271;
(e-ii) the amino acid sequence of SEQ ID NO.:207 and the amino acid sequence of SEQ ID NO.:271;
(e-iii) the amino acid sequence of SEQ ID NO.:208 and the amino acid sequence of SEQ ID NO.:271;
(e-iv) the amino acid sequence of SEQ ID NO.:209 and the amino acid sequence of SEQ ID NO.:271;
(e-v) the amino acid sequence of SEQ ID NO.:210 and the amino acid sequence of SEQ ID NO.:271;
(e-vi) the amino acid sequence of SEQ ID NO.:211 and the amino acid sequence of SEQ ID NO.:271;
(e-vii) the amino acid sequence of SEQ ID NO.:212 and the amino acid sequence of SEQ ID NO.:271;
(e-viii) the amino acid sequence of SEQ ID NO.:213 and the amino acid sequence of SEQ ID NO.:271;
(e-ix) the amino acid sequence of SEQ ID NO.:214 and the amino acid sequence of SEQ ID NO.:271;
(e-x) the amino acid sequence of SEQ ID NO.:215 and the amino acid sequence of SEQ ID NO.:271;
(e-xi) the amino acid sequence of SEQ ID NO.:216 and the amino acid sequence of SEQ ID NO.:271;
(e-xii) the amino acid sequence of SEQ ID NO.:217 and the amino acid sequence of SEQ ID NO.:271;
(f-i) the amino acid sequence of SEQ ID NO.:200 and the amino acid sequence of SEQ ID NO.:272;
(f-ii) the amino acid sequence of SEQ ID NO.:207 and the amino acid sequence of SEQ ID NO.:272;
(f-iii) the amino acid sequence of SEQ ID NO.:208 and the amino acid sequence of SEQ ID NO.:272;
(f-iv) the amino acid sequence of SEQ ID NO.:209 and the amino acid sequence of SEQ ID NO.:272;
(f-v) the amino acid sequence of SEQ ID NO.:210 and the amino acid sequence of SEQ ID NO.:272;
(f-vi) the amino acid sequence of SEQ ID NO.:211 and the amino acid sequence of SEQ ID NO.:272;
(f-vii) the amino acid sequence of SEQ ID NO.:212 and the amino acid sequence of SEQ ID NO.:272;
(f-viii) the amino acid sequence of SEQ ID NO.:213 and the amino acid sequence of SEQ ID NO.:272;
(f-ix) the amino acid sequence of SEQ ID NO.:214 and the amino acid sequence of SEQ ID NO.:272;
(f-x) the amino acid sequence of SEQ ID NO.:215 and the amino acid sequence of SEQ ID NO.:272;
(f-xi) the amino acid sequence of SEQ ID NO.:216 and the amino acid sequence of SEQ ID NO.:272;
(f-xii) the amino acid sequence of SEQ ID NO.:217 and the amino acid sequence of SEQ ID NO.:272;
(g-i) the amino acid sequence of SEQ ID NO.:200 and the amino acid sequence of SEQ ID NO.:424;
(g-ii) the amino acid sequence of SEQ ID NO.:207 and the amino acid sequence of SEQ ID NO.:424;
(g-iii) the amino acid sequence of SEQ ID NO.:208 and the amino acid sequence of SEQ ID NO.:424;
(g-iv) the amino acid sequence of SEQ ID NO.:209 and the amino acid sequence of SEQ ID NO.:424;
(g-v) the amino acid sequence of SEQ ID NO.:210 and the amino acid sequence of SEQ ID NO.:424;
(g-vi) the amino acid sequence of SEQ ID NO.:211 and the amino acid sequence of SEQ ID NO.:424;
(g-vii) the amino acid sequence of SEQ ID NO.:212 and the amino acid sequence of SEQ ID NO.:424;
(g-viii) the amino acid sequence of SEQ ID NO.:213 and the amino acid sequence of SEQ ID NO.:424;
(g-ix) the amino acid sequence of SEQ ID NO.:214 and the amino acid sequence of SEQ ID NO.:424;
(g-x) the amino acid sequence of SEQ ID NO.:215 and the amino acid sequence of SEQ ID NO.:424;
(g-xi) the amino acid sequence of SEQ ID NO.:216 and the amino acid sequence of SEQ ID NO.:424;
(g-xii) the amino acid sequence of SEQ ID NO.:217 and the amino acid sequence of SEQ ID NO.:424;
(h-i) the amino acid sequence of SEQ ID NO.:200 and the amino acid sequence of SEQ ID NO.:425;
(h-ii) the amino acid sequence of SEQ ID NO.:207 and the amino acid sequence of SEQ ID NO.:425;
(h-iii) the amino acid sequence of SEQ ID NO.:208 and the amino acid sequence of SEQ ID NO.:425;
(h-iv) the amino acid sequence of SEQ ID NO.:209 and the amino acid sequence of SEQ ID NO.:425;
(h-v) the amino acid sequence of SEQ ID NO.:210 and the amino acid sequence of SEQ ID NO.:425;
(h-vi) the amino acid sequence of SEQ ID NO.:211 and the amino acid sequence of SEQ ID NO.:425;

(h-vii) the amino acid sequence of SEQ ID NO.:212 and the amino acid sequence of SEQ ID NO.:425;
(h-viii) the amino acid sequence of SEQ ID NO.:213 and the amino acid sequence of SEQ ID NO.:425;
(h-ix) the amino acid sequence of SEQ ID NO.:214 and the amino acid sequence of SEQ ID NO.:425;
(h-x) the amino acid sequence of SEQ ID NO.:215 and the amino acid sequence of SEQ ID NO.:425;
(h-xi) the amino acid sequence of SEQ ID NO.:216 and the amino acid sequence of SEQ ID NO.:425;
(h-xii) the amino acid sequence of SEQ ID NO.:217 and the amino acid sequence of SEQ ID NO.:425;
(i-i) the amino acid sequence of SEQ ID NO.:200 and the amino acid sequence of SEQ ID NO.:426;
(i-ii) the amino acid sequence of SEQ ID NO.:207 and the amino acid sequence of SEQ ID NO.:426;
(i-iii) the amino acid sequence of SEQ ID NO.:208 and the amino acid sequence of SEQ ID NO.:426;
(i-iv) the amino acid sequence of SEQ ID NO.:209 and the amino acid sequence of SEQ ID NO.:426;
(i-v) the amino acid sequence of SEQ ID NO.:210 and the amino acid sequence of SEQ ID NO.:426;
(i-vi) the amino acid sequence of SEQ ID NO.:211 and the amino acid sequence of SEQ ID NO.:426;
(i-vii) the amino acid sequence of SEQ ID NO.:212 and the amino acid sequence of SEQ ID NO.:426;
(i-viii) the amino acid sequence of SEQ ID NO.:213 and the amino acid sequence of SEQ ID NO.:426;
(i-ix) the amino acid sequence of SEQ ID NO.:214 and the amino acid sequence of SEQ ID NO.:426;
(i-x) the amino acid sequence of SEQ ID NO.:215 and the amino acid sequence of SEQ ID NO.:426;
(i-xi) the amino acid sequence of SEQ ID NO.:216 and the amino acid sequence of SEQ ID NO.:426;
(i-xii) the amino acid sequence of SEQ ID NO.:217 and the amino acid sequence of SEQ ID NO.:426;
(j-i) the amino acid sequence of SEQ ID NO.:200 and the amino acid sequence of SEQ ID NO.:427;
(j-ii) the amino acid sequence of SEQ ID NO.:207 and the amino acid sequence of SEQ ID NO.:427;
(j-iii) the amino acid sequence of SEQ ID NO.:208 and the amino acid sequence of SEQ ID NO.:427;
(j-iv) the amino acid sequence of SEQ ID NO.:209 and the amino acid sequence of SEQ ID NO.:427;
(j-v) the amino acid sequence of SEQ ID NO.:210 and the amino acid sequence of SEQ ID NO.:427;
(j-vi) the amino acid sequence of SEQ ID NO.:211 and the amino acid sequence of SEQ ID NO.:427;
(j-vii) the amino acid sequence of SEQ ID NO.:212 and the amino acid sequence of SEQ ID NO.:427;
(j-viii) the amino acid sequence of SEQ ID NO.:213 and the amino acid sequence of SEQ ID NO.:427;
(j-ix) the amino acid sequence of SEQ ID NO.:214 and the amino acid sequence of SEQ ID NO.:427;
(j-x) the amino acid sequence of SEQ ID NO.:215 and the amino acid sequence of SEQ ID NO.:427;
(j-xi) the amino acid sequence of SEQ ID NO.:216 and the amino acid sequence of SEQ ID NO.:427;
(j-xii) the amino acid sequence of SEQ ID NO.:217 and the amino acid sequence of SEQ ID NO.:427; or
(k) the amino acid sequence of SEQ ID NO.:436 and the amino acid sequence of SEQ ID NO.:437.

A further aspect of the invention provides a binding molecule comprising or consisting of:
(a-i) the amino acid sequence of SEQ ID NO.:200 and the amino acid sequence of SEQ ID NO.:267;
(a-ii) the amino acid sequence of SEQ ID NO.:207 and the amino acid sequence of SEQ ID NO.:267;
(a-iii) the amino acid sequence of SEQ ID NO.:208 and the amino acid sequence of SEQ ID NO.:267;
(a-iv) the amino acid sequence of SEQ ID NO.:209 and the amino acid sequence of SEQ ID NO.:267;
(a-v) the amino acid sequence of SEQ ID NO.:210 and the amino acid sequence of SEQ ID NO.:267;
(a-vi) the amino acid sequence of SEQ ID NO.:211 and the amino acid sequence of SEQ ID NO.:267;
(a-vii) the amino acid sequence of SEQ ID NO.:212 and the amino acid sequence of SEQ ID NO.:267;
(a-viii) the amino acid sequence of SEQ ID NO.:213 and the amino acid sequence of SEQ ID NO.:267;
(a-ix) the amino acid sequence of SEQ ID NO.:214 and the amino acid sequence of SEQ ID NO.:267;
(a-x) the amino acid sequence of SEQ ID NO.:215 and the amino acid sequence of SEQ ID NO.:267;
(a-xi) the amino acid sequence of SEQ ID NO.:216 and the amino acid sequence of SEQ ID NO.:267;
(a-xii) the amino acid sequence of SEQ ID NO.:217 and the amino acid sequence of SEQ ID NO.:267;
(b-i) the amino acid sequence of SEQ ID NO.:200 and the amino acid sequence of SEQ ID NO.:268;
(b-ii) the amino acid sequence of SEQ ID NO.:207 and the amino acid sequence of SEQ ID NO.:268;
(b-iii) the amino acid sequence of SEQ ID NO.:208 and the amino acid sequence of SEQ ID NO.:268;
(b-iv) the amino acid sequence of SEQ ID NO.:209 and the amino acid sequence of SEQ ID NO.:268;
(b-v) the amino acid sequence of SEQ ID NO.:210 and the amino acid sequence of SEQ ID NO.:268;
(b-vi) the amino acid sequence of SEQ ID NO.:211 and the amino acid sequence of SEQ ID NO.:268;
(b-vii) the amino acid sequence of SEQ ID NO.:212 and the amino acid sequence of SEQ ID NO.:268;
(b-viii) the amino acid sequence of SEQ ID NO.:213 and the amino acid sequence of SEQ ID NO.:268;
(b-ix) the amino acid sequence of SEQ ID NO.:214 and the amino acid sequence of SEQ ID NO.:268;
(b-x) the amino acid sequence of SEQ ID NO.:215 and the amino acid sequence of SEQ ID NO.:268;
(b-xi) the amino acid sequence of SEQ ID NO.:216 and the amino acid sequence of SEQ ID NO.:268;
(b-xii) the amino acid sequence of SEQ ID NO.:217 and the amino acid sequence of SEQ ID NO.:268;
(c-i) the amino acid sequence of SEQ ID NO.:200 and the amino acid sequence of SEQ ID NO.:269;
(c-ii) the amino acid sequence of SEQ ID NO.:207 and the amino acid sequence of SEQ ID NO.:269;
(c-iii) the amino acid sequence of SEQ ID NO.:208 and the amino acid sequence of SEQ ID NO.:269;
(c-iv) the amino acid sequence of SEQ ID NO.:209 and the amino acid sequence of SEQ ID NO.:269;
(c-v) the amino acid sequence of SEQ ID NO.:210 and the amino acid sequence of SEQ ID NO.:269;
(c-vi) the amino acid sequence of SEQ ID NO.:211 and the amino acid sequence of SEQ ID NO.:269;
(c-vii) the amino acid sequence of SEQ ID NO.:212 and the amino acid sequence of SEQ ID NO.:269;
(c-viii) the amino acid sequence of SEQ ID NO.:213 and the amino acid sequence of SEQ ID NO.:269;
(c-ix) the amino acid sequence of SEQ ID NO.:214 and the amino acid sequence of SEQ ID NO.:269;
(c-x) the amino acid sequence of SEQ ID NO.:215 and the amino acid sequence of SEQ ID NO.:269;

(c-xi) the amino acid sequence of SEQ ID NO.:216 and the amino acid sequence of SEQ ID NO.:269;
(c-xii) the amino acid sequence of SEQ ID NO.:217 and the amino acid sequence of SEQ ID NO.:269;
(d-i) the amino acid sequence of SEQ ID NO.:200 and the amino acid sequence of SEQ ID NO.:270;
(d-ii) the amino acid sequence of SEQ ID NO.:207 and the amino acid sequence of SEQ ID NO.:270;
(d-iii) the amino acid sequence of SEQ ID NO.:208 and the amino acid sequence of SEQ ID NO.:270;
(d-iv) the amino acid sequence of SEQ ID NO.:209 and the amino acid sequence of SEQ ID NO.:270;
(d-v) the amino acid sequence of SEQ ID NO.:210 and the amino acid sequence of SEQ ID NO.:270;
(d-vi) the amino acid sequence of SEQ ID NO.:211 and the amino acid sequence of SEQ ID NO.:270;
(d-vii) the amino acid sequence of SEQ ID NO.:212 and the amino acid sequence of SEQ ID NO.:270;
(d-viii) the amino acid sequence of SEQ ID NO.:213 and the amino acid sequence of SEQ ID NO.:270;
(d-ix) the amino acid sequence of SEQ ID NO.:214 and the amino acid sequence of SEQ ID NO.:270;
(d-x) the amino acid sequence of SEQ ID NO.:215 and the amino acid sequence of SEQ ID NO.:270;
(d-xi) the amino acid sequence of SEQ ID NO.:216 and the amino acid sequence of SEQ ID NO.:270;
(d-xii) the amino acid sequence of SEQ ID NO.:217 and the amino acid sequence of SEQ ID NO.:270;
(e-i) the amino acid sequence of SEQ ID NO.:200 and the amino acid sequence of SEQ ID NO.:271;
(e-ii) the amino acid sequence of SEQ ID NO.:207 and the amino acid sequence of SEQ ID NO.:271;
(e-iii) the amino acid sequence of SEQ ID NO.:208 and the amino acid sequence of SEQ ID NO.:271;
(e-iv) the amino acid sequence of SEQ ID NO.:209 and the amino acid sequence of SEQ ID NO.:271;
(e-v) the amino acid sequence of SEQ ID NO.:210 and the amino acid sequence of SEQ ID NO.:271;
(e-vi) the amino acid sequence of SEQ ID NO.:211 and the amino acid sequence of SEQ ID NO.:271;
(e-vii) the amino acid sequence of SEQ ID NO.:212 and the amino acid sequence of SEQ ID NO.:271;
(e-viii) the amino acid sequence of SEQ ID NO.:213 and the amino acid sequence of SEQ ID NO.:271;
(e-ix) the amino acid sequence of SEQ ID NO.:214 and the amino acid sequence of SEQ ID NO.:271;
(e-x) the amino acid sequence of SEQ ID NO.:215 and the amino acid sequence of SEQ ID NO.:271;
(e-xi) the amino acid sequence of SEQ ID NO.:216 and the amino acid sequence of SEQ ID NO.:271;
(e-xii) the amino acid sequence of SEQ ID NO.:217 and the amino acid sequence of SEQ ID NO.:271;
(f-i) the amino acid sequence of SEQ ID NO.:200 and the amino acid sequence of SEQ ID NO.:272;
(f-ii) the amino acid sequence of SEQ ID NO.:207 and the amino acid sequence of SEQ ID NO.:272;
(f-iii) the amino acid sequence of SEQ ID NO.:208 and the amino acid sequence of SEQ ID NO.:272;
(f-iv) the amino acid sequence of SEQ ID NO.:209 and the amino acid sequence of SEQ ID NO.:272;
(f-v) the amino acid sequence of SEQ ID NO.:210 and the amino acid sequence of SEQ ID NO.:272;
(f-vi) the amino acid sequence of SEQ ID NO.:211 and the amino acid sequence of SEQ ID NO.:272;
(f-vii) the amino acid sequence of SEQ ID NO.:212 and the amino acid sequence of SEQ ID NO.:272;
(f-viii) the amino acid sequence of SEQ ID NO.:213 and the amino acid sequence of SEQ ID NO.:272;
(f-ix) the amino acid sequence of SEQ ID NO.:214 and the amino acid sequence of SEQ ID NO.:272;
(f-x) the amino acid sequence of SEQ ID NO.:215 and the amino acid sequence of SEQ ID NO.:272;
(f-xi) the amino acid sequence of SEQ ID NO.:216 and the amino acid sequence of SEQ ID NO.:272;
(f-xii) the amino acid sequence of SEQ ID NO.:217 and the amino acid sequence of SEQ ID NO.:272;
(g-i) the amino acid sequence of SEQ ID NO.:200 and the amino acid sequence of SEQ ID NO.:424;
(g-ii) the amino acid sequence of SEQ ID NO.:207 and the amino acid sequence of SEQ ID NO.:424;
(g-iii) the amino acid sequence of SEQ ID NO.:208 and the amino acid sequence of SEQ ID NO.:424;
(g-iv) the amino acid sequence of SEQ ID NO.:209 and the amino acid sequence of SEQ ID NO.:424;
(g-v) the amino acid sequence of SEQ ID NO.:210 and the amino acid sequence of SEQ ID NO.:424;
(g-vi) the amino acid sequence of SEQ ID NO.:211 and the amino acid sequence of SEQ ID NO.:424;
(g-vii) the amino acid sequence of SEQ ID NO.:212 and the amino acid sequence of SEQ ID NO.:424;
(g-viii) the amino acid sequence of SEQ ID NO.:213 and the amino acid sequence of SEQ ID NO.:424;
(g-ix) the amino acid sequence of SEQ ID NO.:214 and the amino acid sequence of SEQ ID NO.:424;
(g-x) the amino acid sequence of SEQ ID NO.:215 and the amino acid sequence of SEQ ID NO.:424;
(g-xi) the amino acid sequence of SEQ ID NO.:216 and the amino acid sequence of SEQ ID NO.:424;
(g-xii) the amino acid sequence of SEQ ID NO.:217 and the amino acid sequence of SEQ ID NO.:424;
(h-i) the amino acid sequence of SEQ ID NO.:200 and the amino acid sequence of SEQ ID NO.:425;
(h-ii) the amino acid sequence of SEQ ID NO.:207 and the amino acid sequence of SEQ ID NO.:425;
(h-iii) the amino acid sequence of SEQ ID NO.:208 and the amino acid sequence of SEQ ID NO.:425;
(h-iv) the amino acid sequence of SEQ ID NO.:209 and the amino acid sequence of SEQ ID NO.:425;
(h-v) the amino acid sequence of SEQ ID NO.:210 and the amino acid sequence of SEQ ID NO.:425;
(h-vi) the amino acid sequence of SEQ ID NO.:211 and the amino acid sequence of SEQ ID NO.:425;
(h-vii) the amino acid sequence of SEQ ID NO.:212 and the amino acid sequence of SEQ ID NO.:425;
(h-viii) the amino acid sequence of SEQ ID NO.:213 and the amino acid sequence of SEQ ID NO.:425;
(h-ix) the amino acid sequence of SEQ ID NO.:214 and the amino acid sequence of SEQ ID NO.:425;
(h-x) the amino acid sequence of SEQ ID NO.:215 and the amino acid sequence of SEQ ID NO.:425;
(h-xi) the amino acid sequence of SEQ ID NO.:216 and the amino acid sequence of SEQ ID NO.:425;
(h-xii) the amino acid sequence of SEQ ID NO.:217 and the amino acid sequence of SEQ ID NO.:425;
(i-i) the amino acid sequence of SEQ ID NO.:200 and the amino acid sequence of SEQ ID NO.:426;
(i-ii) the amino acid sequence of SEQ ID NO.:207 and the amino acid sequence of SEQ ID NO.:426;
(i-iii) the amino acid sequence of SEQ ID NO.:208 and the amino acid sequence of SEQ ID NO.:426;
(i-iv) the amino acid sequence of SEQ ID NO.:209 and the amino acid sequence of SEQ ID NO.:426;

(i-v) the amino acid sequence of SEQ ID NO.:210 and the amino acid sequence of SEQ ID NO.:426;
(i-vi) the amino acid sequence of SEQ ID NO.:211 and the amino acid sequence of SEQ ID NO.:426;
(i-vii) the amino acid sequence of SEQ ID NO.:212 and the amino acid sequence of SEQ ID NO.:426;
(i-viii) the amino acid sequence of SEQ ID NO.:213 and the amino acid sequence of SEQ ID NO.:426;
(i-ix) the amino acid sequence of SEQ ID NO.:214 and the amino acid sequence of SEQ ID NO.:426;
(i-x) the amino acid sequence of SEQ ID NO.:215 and the amino acid sequence of SEQ ID NO.:426;
(i-xi) the amino acid sequence of SEQ ID NO.:216 and the amino acid sequence of SEQ ID NO.:426;
(i-xii) the amino acid sequence of SEQ ID NO.:217 and the amino acid sequence of SEQ ID NO.:426;
(j-i) the amino acid sequence of SEQ ID NO.:200 and the amino acid sequence of SEQ ID NO.:427;
(j-ii) the amino acid sequence of SEQ ID NO.:207 and the amino acid sequence of SEQ ID NO.:427;
(j-iii) the amino acid sequence of SEQ ID NO.:208 and the amino acid sequence of SEQ ID NO.:427;
(j-iv) the amino acid sequence of SEQ ID NO.:209 and the amino acid sequence of SEQ ID NO.:427;
(j-v) the amino acid sequence of SEQ ID NO.:210 and the amino acid sequence of SEQ ID NO.:427;
(j-vi) the amino acid sequence of SEQ ID NO.:211 and the amino acid sequence of SEQ ID NO.:427;
(j-vii) the amino acid sequence of SEQ ID NO.:212 and the amino acid sequence of SEQ ID NO.:427;
(j-viii) the amino acid sequence of SEQ ID NO.:213 and the amino acid sequence of SEQ ID NO.:427;
(j-ix) the amino acid sequence of SEQ ID NO.:214 and the amino acid sequence of SEQ ID NO.:427;
(j-x) the amino acid sequence of SEQ ID NO.:215 and the amino acid sequence of SEQ ID NO.:427;
(j-xi) the amino acid sequence of SEQ ID NO.:216 and the amino acid sequence of SEQ ID NO.:427;
(j-xii) the amino acid sequence of SEQ ID NO.:217 and the amino acid sequence of SEQ ID NO.:427; or
(k) the amino acid sequence of SEQ ID NO.:436 and the amino acid sequence of SEQ ID NO.:437.

The present invention further relates to a nucleic acid molecule encoding the binding molecule of the invention, or a part thereof. The present invention further relates to an expression vector comprising one or more nucleic acid molecule(s) of the invention. The present invention further relates to a host cell transfected with the expression vector of the invention.

The present invention further relates to a method of producing the binding molecule of the invention, the method comprising the steps:
(a) culturing the host cell of claim 12 under conditions allowing expression of the binding molecule according to any one of claims 1 to 11;
(b) optionally recovering said molecule; and, optionally,
(c) further purifying and/or modifying and/or formulating said binding molecule.

The present invention further relates to a pharmaceutical composition comprising or consisting of one or more binding molecules of the invention and optionally a pharmaceutically acceptable carrier.

The present invention further relates to the binding molecule of the invention, or the pharmaceutical composition of the invention, for use in medicine. The present invention further relates to the binding molecule of the invention, or the pharmaceutical composition of the invention, for use in a method of treating, ameliorating or preventing cancer.

The present invention further relates to a method of treating, preventing or ameliorating cancer comprising administering a therapeutically effective amount of the binding molecule the invention, or of the pharmaceutical composition of the invention, to a patient in need thereof.

The present invention further relates to the use of the binding molecule of the invention for preparing a pharmaceutical composition for treating, preventing or ameliorating cancer.

In a preferred embodiment of the binding molecule of the invention, or the pharmaceutical composition of the invention, or the method of invention, or the use of the invention, the cancer is colorectal cancer (CRC), gastric cancer (GC) or pancreatic cancer (PAC).

In a preferred embodiment of the binding molecule of the invention, or the pharmaceutical composition of the invention, or the method of invention, or the use of the invention, the binding molecule is to be used in combination with an immune checkpoint inhibitor, preferably an anti-PD-1 or an anti-PD-1-L1 antibody.

DETAILED DESCRIPTION OF THE INVENTION

Figure 1:
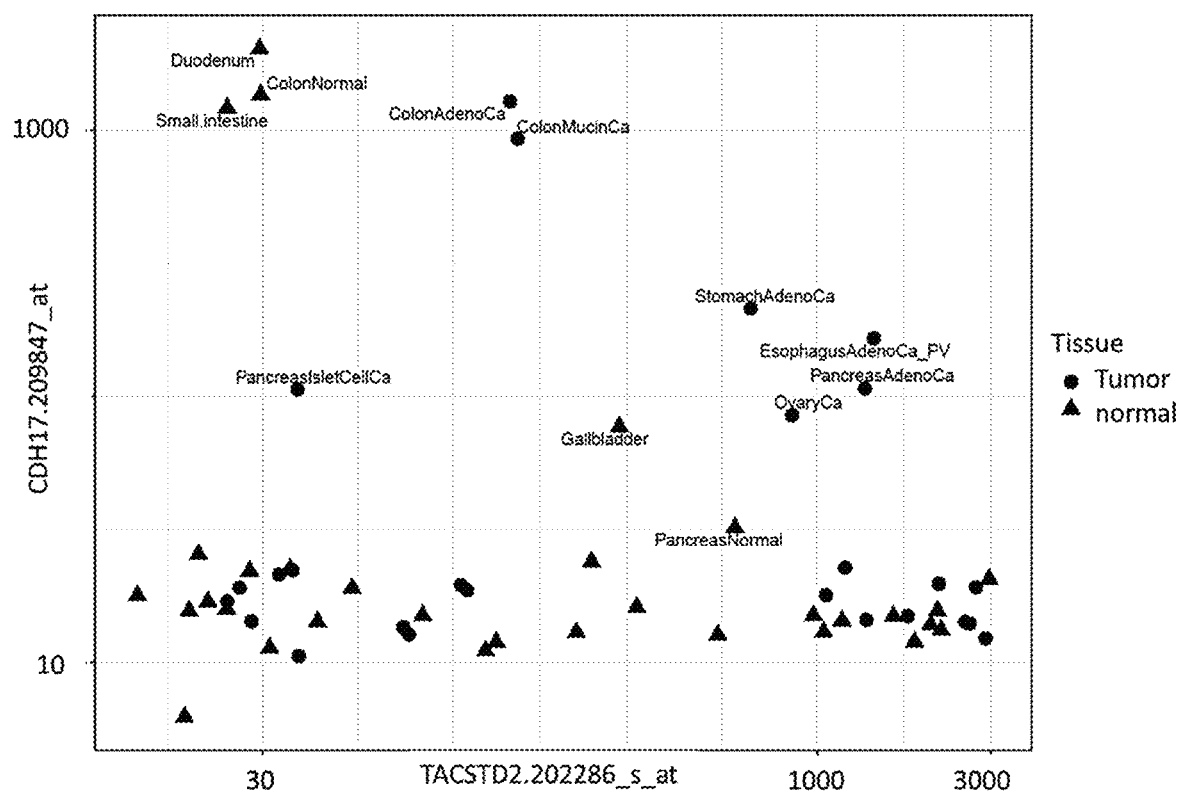
FIG. 1: Co-expression of CDH17 and Trop2 on GI cancer tissues but not on normal tissue. Gene expression in tumor and critical normal tissues. Scales are log 2 transformed arbitrary units of MASS normalized expression values. The axis label is the gene symbol (TACSTD2.202286_s_at=Trop2, CDH17.209847_at =CDH17) and Affymetrix probe set.

In this specification, a number of documents including patent applications and manufacturer's manuals is cited. The disclosure of these documents, while not considered relevant for the patentability of this invention, is herewith incorporated by reference in its entirety. More specifically, all referenced documents are incorporated by reference to the same extent as if each individual document was specifically and individually indicated to be incorporated by reference.
Definitions The above summarised aspects of the invention, as well as other aspects and embodiments of the invention, will become clear from the further description herein, in which:

a) Unless indicated or defined otherwise, all terms used have their usual meaning in the art, which will be clear to the skilled person. In case of conflict, the patent specification, including definitions, will prevail.

Reference is for example made to the standard handbooks, such as Sambrook et al, "Molecular Cloning: A Laboratory Manual" (2nd Ed.), Vols. 1-3, Cold Spring Harbor Laboratory Press (1989); Lewin, "Genes IV", Oxford University Press, New York, (1990), and Roitt et al., "Immunology" (2nd Ed.), Gower Medical Publishing, London, New York (1989), as well as to the general background art cited herein. Furthermore, unless indicated otherwise, all methods, steps, techniques and manipulations that are not specifically described in detail can be performed and have been performed in a manner known per se, as will be clear to the skilled person. Reference is for example again made to the standard handbooks, to the general background art referred to above and to the further references cited therein.

b) Unless indicated or defined otherwise, the term "antibody" is used in accordance with the definitions in the art. Antibodies are typically immunoglobulins (abbreviated Ig), preferably gamma globulin proteins (IgG; see also further below). Naturally occurring antibodies can be found in blood or other bodily fluids of vertebrates, where they are used by the immune system to identify and neutralize foreign objects, such as bacteria and viruses, a function that is mediated by their capability to bind, by non-covalent interaction, to other molecules or structures known as antigens. This binding is specific in the sense that an antibody will only bind to a specific structure with high affinity. The unique part of the antigen recognized by an antibody is called an epitope, or antigenic determinant.

Naturally occurring antibodies (including e.g. classical Y-shaped immunoglobulin molecules) are typically made of basic structural units: each with two large heavy chains and two small light chains—or just two heavy chains as in camelid species or cartilaginous fish (i.e. $V_HH$ and $V_{NAR}$ fragments, respectively)—and which form, for example, monomers with one unit, dimers with two units or pentamers with five units. Each heavy chain has at the N-terminus a variable domain (VH), followed by three or four (in case of IgE) constant domains (CH1, CH2, CH3, and CH4), as well as a hinge region between CH1 and CH2. Each light chain has two domains, an N-terminal variable domain (VL) and a C-terminal constant domain (CL). The part of the antibody that mediates binding to the epitope is sometimes called paratope and resides in the variable domain, or variable region (Fv), of the antibody. The variable domain comprises three so-called complementary-determining region (CDR's) spaced apart by framework regions (FR's). The framework regions adopt a beta-sheet conformation and the CDRs may form loops connecting the beta-sheet structure. The CDRs in each chain are held in their three-dimensional structure by the framework regions and mediate, typically together with the CDRs from the other chain (if/where present), the binding to the antigen. The term "constant domains" or "constant region" as used within the current application denotes the sum of the domains of an antibody other than the variable region. Such constant domains and regions are well known in the state of the art and e.g. described by Kabat et al. ("Sequence of proteins of immunological interest", US Public Health Services, NIH Bethesda, MD, Publication No. 91).

The "Fc part" of an antibody is not involved directly in binding of an antibody to an antigen, but exhibit various effector functions. An "Fc part of an antibody" is a term well known to the skilled artisan and defined on the basis of papain cleavage of antibodies. Depending on the amino acid sequence of the constant region of their heavy chains, antibodies or immunoglobulins are divided in the classes: IgA, IgD, IgE, IgG and IgM. According to the heavy chain constant regions the different classes of immunoglobulins are called α, δ, ε, γ, and μ respectively.

Several of these may be further divided into subclasses (isotypes), e.g. IgG1, IgG2, IgG3, and IgG4, IgA1, and IgA2. The Fc part of an antibody is directly involved in ADCC (antibody dependent cell-mediated cytotoxicity) and CDC (complement-dependent cytotoxicity) based on complement activation, C1q binding and Fc receptor binding. Complement activation (CDC) is initiated by binding of complement factor C1q to the Fc part of most IgG antibody subclasses. While the influence of an antibody on the complement system is dependent on certain conditions, binding to C1q is caused by defined binding sites in the Fc part. Such binding sites are known in the state of the art and described e.g. by Kellner et al. Transfus Med Hemother. 44(5) (2017) 327-336 Non-limiting examples of such binding sites are e.g. L234, L235, D270, N297, E318, K320, K322, P331 and P329 (numbering according to EU index of Kabat). Most crucial among these residues in mediating C1q and Fc gamma receptor binding in IgG1 are L234 and L235 (Hezareh et al., J. Virology 75 (2001) 12161-12168). Antibodies of subclass IgG1 and IgG3 usually show complement activation and C1q and C3 binding, whereas IgG2 and IgG4 do not activate the complement system and do not bind C1q and C3.

The term "antibody", as used herein, also includes fragments of immunoglobulins which retain antigen binding properties, like Fab, Fab', or F(ab')2 fragments. Such fragments may be obtained by fragmentation of immunoglobulins e.g. by proteolytic digestion, or by recombinant expression of such fragments. For example, immunoglobulin digestion can be accomplished by means of routine techniques, e.g. using papain or pepsin (WO 94/29348). Papain digestion of antibodies typically produces two identical antigen binding fragments, so called Fab fragments, each with a single antigen binding site, and a residual Fc fragment. Pepsin treatment yields an F(ab')2. In Fab molecules, the variable domains are each fused to an immunoglobulin constant domain, preferably of human origin. Thus, the heavy chain variable domain may be fused to a CH1 domain (a so-called Fd fragment), and the light chain variable domain may be fused to a CL domain. Such molecules may be produced by recombinant expression of respective nucleic acids in host cells using methods known in the art.

Numerous approaches for modifying naturally occurring antibodies, as well as for placing variable domains of immunoglobulins, or molecules derived from such variable domains, in a different molecular context, have been described in the art, see e.g. Holliger, P., Hudson, P. Nat Biotechnol 23, 1126-1136 (2005) or Nilvebrant, J. et al. Current pharmaceutical design vol. 22,43 (2016): 6527-6537. Typically, the aim of these modifications is to make the antibodies even more versatile tools in medicine and technology. These approaches have led to structurally modified molecules, also referred to as "antibody derivatives" or "modified immunoglobulins" herein, which often differ from the basic make-up of naturally occurring antibodies (i.e. those made up of two large heavy chains and two small light chains— or just two heavy chains as in camelid species or cartilaginous fish). Often, these molecules are smaller in size compared to naturally occurring antibodies, and may comprise a single amino acid chain or several amino acid chains. For example, a single-chain variable fragment (scFv) is a fusion of the variable regions of the heavy and light chains of immunoglobulins, linked together with a short linker, usually serine (S) or glycine (G) (see e.g. WO 88/01649; WO 91/17271). "Single domain antibodies" or "Nanobodies®" harbour an antigen-binding site in a single Ig like domain (see e.g. WO 94/04678; WO 03/050531). Single domain antibodies with binding specificity for the same or a different antigen may be linked together. Diabodies are bivalent antibody molecules consisting of two amino acid chains comprising two variable domains (WO 94/13804). Other examples of antibody-like molecules are immunoglobulin super family antibodies (IgSF; Srinivasan and Roeske, Current Protein Pept. Sci. 2005, 6(2): 185-96). A different concept leads to the so-called Small Modular Immunopharmaceutical (SMIP), which comprises a Fv domain linked to single-chain hinge and effector domains devoid of the constant domain CH1 (WO 02/056910). However, in some cases modifications can also lead to molecules that are larger than naturally occurring antibodies, e.g. when a classical Ig format is combined with additional antigen binding sites, e.g. in the form of scFvs etc. All such antibody derivatives or modified immunoglobulins are also encompassed by the more general term "antibody", as used herein.

Because for application in man it is often desirable to reduce immunogenicity of antibodies originally derived from other species, like mouse, modification approaches like the construction of chimeric antibodies, or the so-called "humanization" of antibodies have been developed. In this context, a "chimeric antibody" is understood to be antibody comprising a sequence part (e.g. a variable domain) derived from one species (e.g. mouse) fused to a sequence part (e.g. the constant domains) derived from a different species (e.g. human). A "humanized antibody" is an antibody comprising a variable domain originally derived from a non-human species, wherein certain amino acids have been mutated to make the overall sequence of that variable domain more closely resemble that of a sequence of a human variable domain. Methods of chimerization and humanization of antibodies are well-known in the art (Billetta R, Lobuglio A F. "Chimeric antibodies". Int Rev Immunol. 1993; 10(2-3):165-76; Riechmann L, Clark M, Waldmann H, Winter G (1988). "Reshaping human antibodies for therapy". Nature: 332:323). The term "human antibodies", as used herein, relates to antibodies that were created based on sequences derived from the human genome, for example by phage display or use of transgenic animals (see e.g. WO 90/05144). The term "antibody", as used herein, explicitly includes such humanized antibodies, chimeric antibodies, as well as human antibodies.

An antibody may further be fused (as a fusion protein) or otherwise linked (by covalent or non-covalent bonds) to other molecular entities having a desired impact on the properties of the antibody. For example, it may be desirable to improve pharmacokinetic properties of antibodies, stability e.g. in body fluids such as blood, in particular in the case of single chain antibodies or domain antibodies. A number of technologies have been developed in this regard, in particular to prolong the half-life of such antibodies in the circulation, such as pegylation (WO 98/25971; WO 98/48837; WO 2004081026), fusing or otherwise covalently attaching the antibody to another antibody having affinity to a serum protein like albumin (WO 2004041865; WO 2004003019), or expression of the antibody as fusion protein with all or part of a serum protein like albumin or transferrin (WO 01/79258). Means and methods for lead identification and lead optimisation in the design of antibodies are well known in the art and have been reviewed, e.g., in Goulet, D. R. and Atkins, W. M. J Pharm Sci 2020; 109(1):74-103 or Tiller, K. E., & Tessier, P. M. (2015). Annual review of biomedical engineering, 17, 191-216.

c) "Antibody mimics" have also been developed, which typically have only a remote structural relationship to an immunoglobulin variable domain, or no such relation at all, but show a certain binding specificity and affinity comparable to an immunoglobulin variable domain. Such non-immunoglobulin "antibody mimics", sometimes called "scaffold proteins", can for example be based on the genes of protein A, the lipocalins, a fibronectin domain, an ankyrin consensus repeat domain, and thioredoxin (Skerra, Current Opinion in Biotechnology 2007, 18(4): 295-304).

d) The term "immunoglobulin variable domain" as used herein means an immunoglobulin domain essentially consisting of four "framework regions" which are referred to in the art and herein below as "framework region 1" or "FR1"; as "framework region 2" or "FR2"; as "framework region 3" or "FR3"; and as "framework region 4" or "FR4", respectively; which framework regions are interrupted by three "complementarity determining regions" or "CDRs", which are referred to in the art and herein below as "complementarity determining region 1" or "CDR1"; as "complementarity determining region 2" or "CDR2"; and as "complementarity determining region 3" or "CDR3", respectively. Thus, the general structure or sequence of an immunoglobulin variable domain can be indicated as follows: FR1-CDR1-FR2-CDR2-FR3-CDR3-FR4. It is the immunoglobulin variable domain(s) that confer specificity to an antibody for the antigen by carrying the antigen-binding site.

e) A molecule (such as the binding molecule of the invention, or a fragment thereof) that can "bind", "bind to", "specifically bind", or "specifically bind to", that "has affinity for" and/or that "has specificity for" a certain epitope, antigen or protein (or for at least one part, fragment or epitope thereof) is said to be "against" or "directed against" said epitope, antigen or protein or is a "binding" molecule with respect to such epitope, antigen or protein.

f) The term "antigen binding site", as used herein, relates to a domain of a binding molecule that confers binding to a specific antigen. Antigen binding sites are originally derived from antibodies, although advances in this field have led to additional possibilities of designing and/or obtaining antigen binding sites without the need for generating a naturally occurring antibody against the target of interest. Irrespective of its origin, an "antigen binding site" in accordance with the present invention comprises at least the minimal structural elements, i.e. the necessary and sufficient structural elements, that allow for binding to its specific target antigen. Thus, an "antigen binding site" in accordance with the present invention comprises at least three heavy chain CDR sequences (in the case of single domain antibodies), more preferably at least three light chain and three heavy chain CDR sequences. As discussed above, these CDRs typically reside in the so-called variable domain, or variable region (Fv) of an antibody. It will be appreciated that whereas an antigen binding site comprises at least the minimal structural elements, it typically encompasses additional elements (such as e.g. the framework regions). Thus, as used in accordance with the present invention, an antigen binding site can also be defined via the sequences of the respective combination of heavy chain variable domain and light chain variable domain. It is particularly preferred in accordance with the present invention that an "antigen binding site" is comprised in a polypeptide and/or that each of said CDRs or said variable domains is/are (a) polypeptide(s) or peptide(s).

g) The term "specific binding" of binding molecules or antigen binding site may be described, for example, in terms of their cross-reactivity. Preferably, the antigen binding sites of the binding molecule of the invention do not or essentially do not cross-react with an epitope that is different from that of the target antigen, but that has a structure similar to that of the target antigen. Preferably, "binds specifically to . . . " refers to antigen binding sites that do not bind to a target with less than 65%, preferably less than 70%, less than 75%, less than 80%, less than 85%, less than 90%, less than 95% and most preferably less than 98% identity (as calculated using methods known in the art) to the specifically recited targets, i.e. the antigens TROP2, CDH17 and CD3, respectively. Cross-reactivity of a panel of molecules under investigation may be tested, for example, by assessing binding of said panel of molecules under conventional conditions to the epitope of interest as well as to a number of more or less (structurally and/or functionally) closely related epitopes. Only those molecules that bind to the epitope of interest in its relevant context (e.g. a specific motif in the structure of a protein) but do not or do not essentially bind to any of the other epitopes are considered to bind specifically. Corresponding methods are described in textbook literature as well as, e.g., in Brooks B D. Curr Drug Discov Technol. 2014 June; 11(2):109-12 or Abdiche Y N, et al. PLoS One. 2014 Mar. 20; 9(3):e92451

"Specificity" may, however, also be described or specified in terms of their affinity and/or avidity.

The affinity, represented by the equilibrium constant for the dissociation of an antigen with a binding molecule (Kd), is a measure for the binding strength between an epitope and an antigen binding site on the binding molecule: the lesser the value of the Kd, the stronger the binding strength between an epitope and the binding molecule (alternatively, the affinity can also be expressed as the affinity constant (Ka), which is 1/Kd).

It is particularly preferred that an antigen binding site that binds specifically to its target has a significantly higher binding affinity to the respective target, i.e. the antigen TROP2, CDH17 or CD3, than to structurally unrelated molecules. Thus, the antigen binding site for TROP2 has a significantly higher binding affinity to TROP2 than to any other, structurally unrelated molecule; the antigen binding site for CDH17 has a significantly higher binding affinity to CDH17 than to any other, structurally unrelated molecule and the antigen binding site for CD3 has a significantly higher binding affinity to CD3 than to any other, structurally unrelated molecule. In accordance with the present invention, an antigen binding site is considered to have a significantly higher binding affinity to its target antigen if it binds to said target antigen with an affinity that is at least two fold greater, preferably at least ten times greater, more preferably at least 20-times greater, and most preferably at least 100-times greater under identical conditions than the affinity for unrelated antigens.

Preferred binding affinities vary depending on the binding molecule but include those with a dissociation constant (Kd) of at least 10E-4 moles/liter or lower, as measured e.g. via any standard methodology known in the art, preferably via a Biacore assay as described below and in the appended examples. Any Kd value greater than 10E-4 M is generally considered to indicate non-specific binding. Preferably, an antigen binding site will specifically bind to the desired antigen with a Kd less than 500 nM, preferably less than 200 nM, more preferably less than 100 nM, and most preferably less than 20 nM. For certain binders, such as e.g. the antigen binding sites for CD3 described herein, and unless defined otherwise herein, it is preferred that the dissociation constant (Kd) is less than 10 nM, more preferably less than 5 nM and even more preferably less than 2 nM.

Avidity is the measure of the strength of binding between a binding molecule (such as the binding molecule of the invention, or a fragment thereof) and the pertinent antigen(s). Avidity is related to both the affinity between an epitope and its antigen binding site on the binding molecule and the number of pertinent binding sites present on the binding molecule.

As will be clear to the skilled person (for example on the basis of the further disclosure herein), specific binding can be determined using means and methods known per se in the art, depending on the specific antigen of interest. Such means and methods include, without being limiting, Scatchard analysis and/or competitive binding assays, such as radioimmunoassays (RIA), enzyme immunoassays (EIA) and sandwich competition assays, and plasmon resonance assay (Malmqvist M., Curr Opin Immunol. 1993 April; 5(2):282-6.) with e.g. purified wild-type antigen. Antibody affinity can also be measured using kinetic exclusion assay (KinExA) technology (Darling, R. J., and Brault P-A., ASSAY and Drug Development Technologies. 2004 Dec. 2(6): 647-657). Preferably, specific binding is determined by plasmon resonance assay with purified wild-type antigen. More preferably, the method for determining the Kd value is based on a Biacore assay, as described for example in Example 3.2 below. Thus, it is preferred that any Kd values referred to herein are Kd values obtained via surface plasmon resonance (SPR) on Biacore 4000, wherein the binding molecule of interest is captured via Protein A/G onto the sensor surface for 60 sec at 10 μl/min, then the respective target molecule (e.g. human Trop2, CDH17 or CD3) is applied, preferably at a concentration of 100 nM for 180 sec of association at 30 μl/min, followed by 120 sec of dissociation in HBS-EP buffer.

h) Amino acid residues will be indicated according to the standard three-letter or one-letter amino acid code, as generally known and agreed upon in the art. When comparing two amino acid sequences, the term "amino acid difference" refers to insertions, deletions or substitutions of the indicated number of amino acid residues at a position of the reference sequence, compared to a second sequence. In case of substitution(s), such substitution(s) will preferably be conservative amino acid substitution(s), which means that an amino acid residue is replaced with another amino acid residue of similar chemical structure and which has little or essentially no influence on the function, activity or other biological properties of the polypeptide. Such conservative amino acid substitutions are well known in the art, for example from WO 98/49185, wherein conservative amino acid substitutions preferably are substitutions in which one amino acid within the following groups (i)-(v) is substituted by another amino acid residue within the same group: (i) small aliphatic, nonpolar or slightly polar residues: Ala, Ser, Thr, Pro and Gly; (ii) polar, negatively charged residues and their (uncharged) amides: Asp, Asn, Glu and Gln; (iii) polar, positively charged residues: His, Arg and Lys; (iv) large aliphatic, nonpolar residues: Met, Leu, Ile, Val and Cys; and (v) aromatic residues: Phe, Tyr and Trp. Particularly preferred conservative amino acid substitutions are as follows:

Ala into Gly or into Ser;
Arg into Lys;
Asn into Gln or into His;
Asp into Glu;
Cys into Ser;
Gln into Asn;
Glu into Asp;
Gly into Ala or into Pro;
His into Asn or into Gln;
Ile into Leu or into Val;
Leu into Ile or into Val;
Lys into Arg, into Gln or into Glu;
Met into Leu, into Tyr or into Ile;
Phe into Met, into Leu or into Tyr;
Ser into Thr;
Thr into Ser;
Trp into Tyr;
Tyr into Trp or into Phe;
Val into Ile or into Leu.

i) The term "isolated," as used herein, refers to material that is removed from its original or native environment (e.g. the natural environment if it is naturally occurring). For example, a naturally-occurring nucleic acid molecule or polypeptide present in a living animal is not isolated, but the same nucleic acid molecule or polypeptide, separated by human intervention from some or all of the co-existing materials in the natural system, is isolated. Such nucleic acid molecules could be part of a vector and/or such nucleic acid molecules or polypeptides could be part of a composition, and still be isolated in that such vector or composition is not part of the environment in which the nucleic acid molecule or the polypeptide is found in nature. For example, a nucleic acid molecule or polypeptide is considered to be "(in) essentially isolated (form)" when, compared to its native biological source and/or the reaction medium or cultivation medium from which it has been obtained, it has been separated from at least one other component with which it is usually associated in said source or medium, such as another nucleic acid molecule, another polypeptide, another biological component or macromolecule or at least one contaminant, impurity or minor component. In particular, a nucleic acid molecule or polypeptide is considered "essentially isolated" when it has been purified at least 2-fold, in particular at least 10-fold, more in particular at least 100-fold, and up to 1000-fold or more. A nucleic acid molecule or polypeptide that is "in essentially isolated form" is preferably essentially homogeneous, as determined using a suitable technique, such as a suitable chromatographical technique, e.g., polyacrylamide-gel-electrophoresis. Binding molecules and nucleic acids of the present invention are preferably isolated.

j) Unless indicated otherwise, the term "sequence" as used herein (for example in terms like "immunoglobulin sequence", "binding molecule sequence", or "polypeptide sequence"), should generally be understood to include both the relevant amino acid sequence as well as nucleic acid sequences or nucleotide sequences encoding the same, unless the context requires a more limited interpretation.

k) As used herein, the terms "identical" or "percent identity," in the context of two or more nucleic acid or polypeptide sequences, refer to two or more sequences or sub-sequences that are the same or have a specified percentage of nucleotides or amino acid residues that are the same, when compared and aligned for maximum correspondence. To determine the percent identity, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)× 100). In some embodiments, the two sequences that are compared are the same length after gaps are introduced within the sequences, as appropriate (e.g., excluding additional sequence extending beyond the sequences being compared). For example, when variable region sequences are compared, the leader and/or constant domain sequences are not considered. For sequence comparisons between two sequences, a "corresponding" CDR refers to a CDR in the same location in both sequences (e.g., CDR-H1 of each sequence).

The determination of percent identity or percent similarity between two sequences can be accomplished using a mathematical algorithm. A preferred, non-limiting example of a mathematical algorithm utilized for the comparison of two sequences is the algorithm of Karlin and Altschul, 1990, Proc. Natl. Acad. Sci. USA 87:2264-2268, modified as in Karlin and Altschul, 1993, Proc. Natl. Acad. Sci. USA 90:5873-5877. Such an algorithm is incorporated into the NBLAST and XBLAST programs of Altschul et al., 1990, J. Mol. Biol. 215:403-410. BLAST nucleotide searches can be performed with the NBLAST program, score=100, word length=12, to obtain nucleotide sequences homologous to a nucleic acid encoding a protein of interest. BLAST protein searches can be performed with the XBLAST program, score=50, wordlength=3, to obtain amino acid sequences homologous to a protein of interest. To obtain gapped alignments for comparison purposes, Gapped BLAST can be utilized as described in Altschul et al., 1997, Nucleic Acids Res. 25:3389-3402. Alternatively, PSI-Blast can be used to perform an iterated search which detects distant relationships between molecules (Id.). When utilizing BLAST, Gapped BLAST, and PSI-Blast programs, the default parameters of the respective programs (e.g., XBLAST and NBLAST) can be used. Another preferred, non-limiting example of a mathematical algorithm utilized for the comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Additional algorithms for sequence analysis are known in the art and include ADVANCE and ADAM as described in Torellis and Robotti, 1994, Comput. Appl. Biosci. 10:3-5; and FASTA described in Pearson and Lipman, 1988, Proc. Natl. Acad. Sci. USA 85:2444-8. Within FASTA, ktup is a control option that sets the sensitivity and speed of the search. If ktup=2, similar regions in the two sequences being compared are found by looking at pairs of aligned residues; if ktup=1, single aligned amino acids are examined. ktup can be set to 2 or 1 for protein sequences, or from 1 to 6 for DNA sequences. The default if ktup is not specified is 2 for proteins and 6 for DNA. Alternatively, protein sequence alignment may be carried out using the CLUSTAL W algorithm, as described by Higgins et al., 1996, Methods Enzymol. 266:383-402. Preferably, the CLUSTAL W algorithm described above is used.

l) The term "comprising", as used herein, denotes that further components and/or steps can be included in addition to the specifically recited components and/or steps. However, this term also encompasses that the claimed subject matter consists of exactly the recited components and/or steps.

m) As used herein, the term "at least", refers to any number including the specifically recited number and any number higher than that. For example, "at least one" encompasses exactly one, as well as more than one, including without being limiting two, such as for example three or four. Further included is e.g. five, six, seven, eight, nine, 10, 15, such as 20, 30, 40, 50, 75, 100, 150, 200, 300, 400 or 500, as well as any integer number in between or above these specifically recited numbers. With regard to the term "at least one antigen binding site", it is particularly preferred that said term encompasses one, two, three or four antigen binding site(s). Most preferably, said term relates to exactly one antigen binding site. In those cases where more than one antigen binding site is chosen for a target, these multiple antigen binding sites can be chosen independently, i.e. they can be identical or they can differ from each other.

n) The term "polypeptide" as used herein describes linear molecular chains of amino acids, including single chain polypeptides or their fragments, containing more than 30 amino acids. On the other hand, the term "peptide" as used in the present invention describes linear chains of amino acids containing up to 30 amino acids. The term "(poly)peptide" as used in accordance with the present invention refers to a group of molecules which comprises the group of peptides, consisting of up to 30 amino acids, as well as the group of polypeptides, consisting of more than 30 amino acids.

o) The term "linker", as used herein, encompasses both peptide linkers, i.e. a sequence of amino acids, as well as non-peptide linkers, which covalently or non-covalently connect individual parts of a molecule. The term "non-peptide linker", as used herein, refers to linkage groups having two or more reactive groups but excluding peptide linkers as defined below. For example, the non-peptide linker may be a polymer having reactive groups at both ends, which individually bind to reactive groups of the binding portions of the molecule of the invention, for example, an amino terminus, a lysine residue, a histidine residue or a cysteine residue. The reactive groups of the polymer include an aldehyde group, a propionic aldehyde group, a butyl aldehyde group, a maleimide group, a ketone group, a vinyl sulfone group, a thiol group, a hydrazide group, a carbonyldimidazole (CDI) group, a nitrophenyl carbonate (NPC) group, a trysylate group, an isocyanate group, and succinimide derivatives. Examples of succinimide derivatives include succinimidyl propionate (SPA), succinimidyl butanoic acid (SBA), succinimidyl carboxymethylate (SCM), succinimidyl succinamide (SSA), succinimidyl succinate (SS), succinimidyl carbonate, and N-hydroxy succinimide (NHS). The reactive groups at both ends of the non-peptide polymer may be the same or different. For example, the non-peptide polymer may have a maleimide group at one end and an aldehyde group at another end.

Peptide linkers, as envisaged herein, are (poly)peptide linkers of at least 1 amino acid in length. Preferably, the linkers are 1 to 100 amino acids in length. More preferably, the linkers are 5 to 50 amino acids in length, more preferably 10 to 40 amino acids in length, and even more preferably, the linkers are 15 to 30 amino acids in length. Non-limiting examples of often used small linkers include sequences of glycine and serine amino acids, termed GS mini-linker. The number of amino acids in these linkers can vary, for example, they can be 4 (GGGS) (SEQ ID NO:273), or 6 (GGSGGS) (SEQ ID NO:274), or multiples thereof, such as e.g. two or three or more repeats of these four/six amino acids. Most preferably, such GS mini-linkers have 20 amino acids and the sequence GGGGSGGGGSGGGGSGGGGS (SEQ ID NO:275).

It will be appreciated by the skilled person that when the molecule of interest is a single polypeptide chain, the linker is a peptide linker.

It is known in the art that the nature, i.e. the length and/or compositions, such as e.g. the amino acid sequence, of the linker may modify or enhance the stability and/or solubility of the molecule which contains the linker. Typically, the length and sequence of a linker is chosen depending on the composition of the respective molecule of interest. The skilled person is well aware of methods to design and test the suitability of different linkers, see e.g. Völkel, T. et al. Protein Engineering, Design and Selection, Volume 14, Issue 10, 2001, Pages 815-823. For example, the properties of the molecule can easily be tested by comparing the binding affinity of the binding portions of the molecule of the invention. In case of the tri-specific molecule of the invention, the respective measurements for each binding portion may be carried out separately. The stability of the resulting molecule can be measured using an ELISA based method to determine the residual binding capacity of the molecule after incubation in human serum at 37° C. for several time periods. Other suitable tests can e.g. be found in Brian R. Miller, B. R. et al. Protein Engineering, Design and Selection, Volume 23, Issue 7, 2010, Pages 549-557 or Kugler, M. et al. Protein Engineering, Design and Selection, Volume 22, Issue 3, 2009, Pages 135-147.

(p) The term "nucleic acid molecule", in accordance with the present invention, which is used interchangeably with the term "polynucleotide" herein, includes DNA, such as for example cDNA or genomic DNA, and RNA, for example mRNA. Further included are nucleic acid mimicking molecules known in the art such as for example synthetic or semi-synthetic derivatives of DNA or RNA and mixed polymers. Such nucleic acid mimicking molecules or nucleic acid derivatives according to the invention include phosphorothioate nucleic acid, phosphoramidate nucleic acid, 2'-O-methoxyethyl ribonucleic acid, morpholino nucleic acid, hexitol nucleic acid (HNA) and locked nucleic acid (LNA). LNA is an RNA derivative in which the ribose ring is constrained by a methylene linkage between the 2'-oxygen and the 4'-carbon. They may contain additional non-natural or derivative nucleotide bases, as will be readily appreciated by those skilled. in the art.

Tri-Specific Binding Molecules of the Invention

The present invention relates to a binding molecule comprising: (a) at least one antigen binding site that binds specifically to trophoblast cell-surface antigen 2 (TROP2), preferably human TROP2, with a Kd≥1 nM, (b) at least one antigen binding site that binds specifically to cadherin-17 (CDH17), preferably human CDH17, with a Kd≥10 nM, preferably with a Kd≥100 nM and (c) at least one antigen binding site that binds specifically to cluster of differentiation 3 (CD3), preferably human CD3.

Thus, the binding molecule of the invention (also referred to herein as the "protein of the invention" or the "binder of the invention") comprises at least the specifically recited three different antigen binding sites, i.e. at least one binding site for TROP2, at least one binding site for CDH17 and at least one binding site for CD3. Because of these three specificities, the binding molecule of the invention is also referred to herein as the "tri-specific binding molecule" of the invention.

The term TROP2, as used herein, refers to "trophoblast cell-surface antigen 2". TROP2 belongs to the family of tumor-associated calcium signal transducer (TACSTD) and is required for the stability of claudin-7 and claudin-1. Human TROP2 is represented by SEQ ID NO: 419 as well as in database accession number UniProt P09758.

The term CDH17, as used herein, refers to "cadherin-17". CDH17 is a member of the cadherin superfamily of calcium-dependent, membrane-associated glycoproteins. The encoded protein is cadherin-like, consisting of an extracellular region, containing 7 cadherin domains, and a transmembrane region but lacking the conserved cytoplasmic domain. Expression of the protein in the gastrointestinal tract and pancreatic ducts has been reported. Human CDH17 is represented by SEQ ID NO: 420 as well as in database accession number UniProt Q12864.

The term CD3, as used herein, refers to "cluster of differentiation 3". CD3 is a protein complex and T cell co-receptor that is involved in activating both the cytotoxic T cell, i.e. CD8+ naive T cells, and T helper cells, i.e. CD4+ naive T cells. CD3 is composed of four distinct chains, wherein the complex contains in mammals a CD3γ chain, a CD3δ chain, and two CD3ε chains. Together with the T-cell receptor (TCR) and the ζ-chain (zeta-chain), CD3 generates an activation signal in T lymphocytes. Human CD3 is represented by SEQ ID No: 421 as well as by database accession number UniProtKB-P04234 for the CD3 delta chain, SEQ ID No:422 as well as by database accession number UniProtKB-P07766 for the CD3 epsilon chain, SEQ ID No:423 as well as by database accession number UniProtKB-P09693 for the CD3 gamma chain and SEQ ID No:424 as well as by database accession number UniProtKB-P20963 for the CD3 zeta chain.

The general structure of antigen binding sites is well known in the art and can be, for example, a single domain, such as an epitope binding domain, a single chain Fv (ScFv) domain, or a paired VH/VL domain, as discussed herein above. In a preferred embodiment, the antigen binding site comprises at least a light chain variable domain and a heavy chain variable domain.

As discussed with regard to the general definitions, it is required that the antigen binding sites bind specifically to their respective target antigen. In addition, the binding molecule of the present invention is further characterised in that the antigen binding sites that specifically bind to TROP2 and CDH17, respectively, bind with a Kd that is not below 1 nM in the case of TROP2 and a Kd that is not below 10 nM (preferably not below 100 nM) in the case of CDH17. In other words, while said antigen binding sites are required to be specific for their target antigen, they are not selected for strong binding affinity, but instead are required to bind with a lower affinity that allows for strong binding of the binding molecule of the present invention only in the presence of both targets. As will be discussed in more detail below, and as shown in the Examples (in particular Examples 6 to 8), the requirement that these two antigen binding sites have a reduced affinity to their respective antigen was found to result in low monovalent binding, but enhanced binding of the resulting tri-specific binding molecule of the invention in presence of both targets due to avidity. It is particularly preferred that the antigen binding site for TROP2 has a Kd between 1 nM and 20 nM, more preferably between 1 nM and 10 nM, even more preferably between 1 nM and 4 nM. Most preferably, the antigen binding site that specifically binds to TROP2 has a Kd that is between 2 nM and 5 nM. Further, it is particularly preferred that the antigen binding site for CDH17 has a Kd between 10 nM and 200 nM, more preferably between 50 nM and 150 nM, even more preferably between 75 nM and 125 nM. Most preferably, the antigen binding site that specifically binds to CDH17 has a Kd that is between 100 nM and 120 nM. Preferably, said Kd is determined as described above with regard to SPR on a Biacore 4000.

In accordance with the present invention, such a requirement of a reduced affinity binder is not necessary for the antigen binding sites that binds to CD3. Thus, and as stated herein above, for the antigen binding sites that targets CD3 it is particularly preferred that the binder will bind with a Kd less than 500 nM, preferably less than 200 nM, more preferably less than 10 nm, and, most preferably, with a Kd of less than 2 nM. Numerous antigen binding sites that specially bind to CD3 have been described in the art, for example in WO2004106383, where well-known antigen binding sites derived from antibodies selected from the group consisting of X35-3, VIT3, BMA030 (BW264/56), CLB-T3/3, CRIS7, YTH12.5, F111-409, CLB-T3.4.2, TR-66, WT32, SPv-T3b, 11 D8, XIII-141, XIII-46, XIII-87, 12F6, T3/RW2-808, T3/RW2-4136, OKT3D, M-T301, SMC2, WT31 and F101.01.e are described, as well as SP34. In particular, WO2004106383 describes VH and VL regions are derived from antibodies/antibody derivatives and the like which are capable of specifically recognizing the human CD3-ε chain in the context of other TCR subunits, e.g. in mouse cells transgenic for human CD3-ε chain. Further non-limiting examples of suitable CD3-specific antigen binding sites are provided in US20180118848, WO2011090762 (e.g. CRIS-7, OKT3, HU291, G19-4), U.S. Pat. No. 9,782,478, US20180118827 (SP34 modifications), US20160145340 (SP34 modifications), U.S. Pat. No. 9,212, 225 (e.g. modifications of SP34 CDRs), U.S. Ser. No. 10/174,124 (CD3 hybridoma clones including clones 40G5C and 38E4.V1), U.S. Pat. No. 9,914,776 and WO2020127619 (SP34 modifications) U.S. Pat. Nos. 7,728, 114, 5,929,212, WO2014047231 (based on OKT3 or CRIS-7), WO2004108158 (based on OKT3), WO200703320 (CD3 clones 28F11, 27H5, 23F10, 15C3), U.S. Ser. No. 10/066,015 (SP34 modifications), WO2018201051 (SP34 modifications), WO201911871, U.S. Pat. No. 99,759,662, US20180326058, WO2019131988 (including SP34 (mu, hu), OKT3, UCHT1.v9, UCHT1, v1, UCHT1.vM1, HU40G5C, 38E4.V1, anti-CD3 clones AN104, AN119, AN121, AN395), US20180161428, WO2019075378 (SP34 CDR variants), WO2016187594 (e.g. CDRS related to muromonab-CD3 (OKT3), otelixizumab (TRX4), teplizumab (MGA031), visilizumab (Nuvion), SP34, X35, VIT3, BMA030 (BW264/56), CLB-T3/3, CRIS7, YTH12.5, F111-409, CLB-T3.4.2, TR-66, WT32, SPv-T3b, 11D8, XIII-141, XIII-46, XIII-87, 12F6, T3/RW2-808, T3/RW2-4136, OKT3D, M-T301, SMC2, F101.01, UCHT-1 and WT-31), U.S. Ser. No. 10/066,016 (SP34 CDR variants), WO20180209298 (tritac), or U.S. Ser. No. 10/544,221 (SP34 CDR variants).

Antigen binding sites for the recited targets can be chosen by the skilled person from the antigen binding sites described herein, from antigen binding sites described in the art (such as those known in the art for CD3, as detailed above), or from antigen binding sites newly developed, in each case provided that the above described prerequisites with regard to specificity (i.e. specific binding for the respective target, but for TROP2 and CDH17 with the proviso that the Kd is not too low as defined above) are fulfilled. Means and methods for testing these requirements have been provided above and can be applied by the skilled person without further ado.

Whereas the antigen binding sites of the binding molecule of the invention are listed as (a), (b) and (c), this listing is not intended to dictate a specific order or arrangement. Thus, the antigen binding sites can be arranged in any order within the binding molecule of the invention, such as for example (a)-(b)-(c), (b)-(c)-(a), (c)-(a)-(b), (b)-(a)-(c) etc. Preferred arrangements of the antigen binding sites within the binding molecule of the invention will be detailed further below.

Importantly, the binding molecule of the present invention is capable of binding all three targets (TROP2, CDH17 and CD3) at (substantially) the same time. Accordingly, provided all three targets are present, the binding molecule of the present invention will bind to all three of them, thereby acting as a T cell engager (TcE): it will bind to CD3 on a T cell and, thus, will bring the T cell into proximity with a tumour cell that expresses both TROP2 and CDH17. Whether a binding molecule of interest is capable of binding to both Trop2 and CDH17 on the surface of a target cell, and can induce T cell activity, can be determined as described in the appended examples, for example using recombinant HEK293 cells or a cancer cell line endogenously expressing the antigens, such as e.g. the colorectal cancer DLD-1 cell line, both of which have been described in Example 9.

In a preferred embodiment, the binding molecule of the invention contains no further antigen binding sites other than the specifically recited three antigen binding sites for TROP2, CDH17 and CD3. Even more preferably, the binding molecule of the invention is tri-specific and tri-valent, i.e. it contains one binding site for each of the three antigen targets.

The binding molecule of the present invention is not particularly limited with regard to its format, provided that it comprises at least the specifically recited three different antigen binding sites (TROP2, CDH17 and CD3) and that is capable of binding these three targets at (substantially) the same time as defined herein. As such, the format can be based on the format of a naturally occurring antibody or of an antibody derivative, or fragments of such antibodies, as well as antibody mimics. Such formats can be modified as needed to accommodate all three antigen binding sites, for example by additionally comprising a further antibody fragment, in particular a Fv, Fab, Fab', or F(ab')2 fragment, a single chain antibody, in particular a single chain variable fragment (scFv), a Small Modular Immunopharmaceutical (SMIP), a domain antibody, or a nanobody. Further non-limiting examples of suitable formats that can be employed, either individually or for all antigen binding sites, include the antibody mimics defined herein above.

Preferably, the binding molecule of the present invention is a modified immunoglobulin (also referred to herein as modified immunoglobulin molecule). For example, in a preferred embodiment, the antigen binding sites for TROP2 and CDH17 reside in the variable region of a binding molecule that has a (classical, Y-shaped) immunoglobulin format. In such a format, a first set of immunoglobulin light and heavy chain contains in its variable region the antigen binding site for TROP2 and a second set of immunoglobulin light and heavy chain contains in its variable region the antigen binding site for CDH17, and both sets of chains are linked with each other to form an immunoglobulin molecule, for example via disulphide bridges.

Techniques for making such immunoglobulin molecules are well known in the art and include, without being limiting, recombinant co-expression of two immunoglobulin heavy chain-light chain pairs having different specificities (e.g. Milstein and Cuello, Nature 305: 537 (1983)), WO 93/08829, and Traunecker et al., EMBO J. 10: 3655 (1991)); "knob-in-hole" engineering (e.g., U.S. Pat. No. 5,731,168); engineering electrostatic steering effects for making antibody Fc-heterodimeric molecules (WO 2009/089004A1); cross-linking of two or more immunoglobulins or fragments (e.g., U.S. Pat. No. 4,676,980, and Brennan et al., Science, 229: 81 (1985)); using leucine zippers to produce bi-specific antibodies (see, e.g., Kostelny et al., Immunol., 148(5): 1547-1553 (1992)) etc. The skilled person is well of aware of such methods, which have also been reviewed in the art, e.g. in Liu H. et al. (2017) Front. Immunol. 8:38. doi: 10.3389/fimmu.2017.00038 or in Moore, G. L., Methods, Volume 154, 2019, Pages 38-50.

Said immunoglobulin molecule is further modified by fusion of additional components comprising the antigen binding site for CD3, thereby resulting in a modified immunoglobulin. Preferably, said antigen binding site for CD3 is a scFv that is fused to the C-terminus of either one or both of the heavy chain(s) of the immunoglobulin molecule. The fusion of various components to each other is well known in the art. Said fusion can, for example, be via peptide linkers, or via non-peptide linkers. Preferably, said fusion is via (a) peptide linker(s).

More preferably, said immunoglobulin molecule and/or said modified immunoglobulin molecule is a monoclonal, a chimeric, a humanized or a human immunoglobulin (e.g. antibody) molecule. Further preferred is that the heavy chain constant region of said immunoglobulin molecule is selected from the group consisting of IgG1, IgG2, IgG3, IgG4, IgM, IgA and IgE constant regions. In another preferred embodiment, the light chain constant region of said immunoglobulin molecule is kappa or lambda.

In accordance with the present invention, the individual elements making up the binding molecule of the present invention can be connected to each other via one or more linkers. Preferably, these linkers are peptide linkers and more preferably, they connect the individual elements via a covalent. It is particularly preferred herein that the respective light chains are connected to their respective heavy chains via a linker.

In those embodiments where the binding molecule of the present invention contains more than one linker it is envisaged that said linkers can have the same or different lengths and may be composed of the same or a different structure, e.g. comprise the same or a different amino acid sequence or the same or a different non-peptide polymer. In a preferred embodiment, the linkers present in the binding molecule of the present invention differ in length and/or structure (e.g. amino acid sequence or the nature of the non-peptide polymer) from each other.

Preferably, the linker is a peptide linker. More preferably, the linker is a flexible linker using e.g. the amino acids alanine and serine or glycine and serine, such as e.g. the linker shown in SEQ ID NO:275, or is one of the linkers shown in SEQ ID Nos: 265 and 266. Thus, it is particularly preferred that the binding molecule of the present invention is entirely composed of amino acids, i.e. it is a polypeptide.

To the inventors best knowledge, neither tri-specific antibodies nor recombinant tri-specific antibody derivatives connecting Trop2 and CDH17 on cancer cells and CD3 on immune cells have been reported so far wherein the Trop2- and CDH17-specific binders bind their targets with a Kd above 1 nM and 10 nM, respectively. WO21113748 is a patent application that describes various formats of multi-specific antibodies including a molecule termed "TriAx-E" that binds to Trop2, CDH17 and/or CD3, however, any attempts of the present inventors to reproduce said molecule failed due to insufficient stability. Classical antibody selection campaigns are normally geared towards yielding high affinity-binders. This is also the approach followed in WO21113748. However, the present inventors surprisingly found that the incorporation of antigen binding sites with high affinity to these two targets resulted in a narrow therapeutic window. As shown in the Examples, in particular in Examples 6 to 8, the use of higher affinities led to monovalent binding and activity on cells expressing only one or the other target, thus increasing the risk of unwanted side effects. In addition, also the use of polyvalent formats decreased the therapeutic window. These findings show that increased affinity for any of the two targets leads to loss of specificity, an effect that is even further enhanced with increased valency. Therefore, a different selection strategy was chosen that focused on obtaining low-affinity binders. As is evident from the Examples below, the tri-specific binding molecules of the present invention provide superior specificity to target cells. Best results were obtained for binding molecules in which low-affinity and monovalent binders are combined, as shown in the Examples below.

In another preferred embodiment of the binding molecule of the present invention, the at least one antigen binding site that binds specifically to TROP2 is selected from the group consisting of antigen binding sites (i) to (vi):

(i) an antigen binding site comprising heavy chain CDRs comprising the amino acid sequences of SEQ ID NO.:1 (CDR1), SEQ ID NO.:2 (CDR2) and SEQ ID NO.:3 (CDR3) and light chain CDRs comprising the amino acid sequences of SEQ ID NO.:4 (CDR1), SEQ ID NO.:5 (CDR2) and SEQ ID NO.:6 (CDR3);

(ii) an antigen binding site comprising heavy chain CDRs comprising the amino acid sequences of SEQ ID NO.:7 (CDR1), SEQ ID NO.:8 (CDR2) and SEQ ID NO.:9 (CDR3) and light chain CDRs comprising the amino acid sequences of SEQ ID NO.:10 (CDR1), SEQ ID NO.:11 (CDR2) and SEQ ID NO.:12 (CDR3);

(iii) an antigen binding site comprising heavy chain CDRs comprising the amino acid sequences of SEQ ID NO.: 13 (CDR1), SEQ ID NO.:14 (CDR2) and SEQ ID NO.:15 (CDR3) and light chain CDRs comprising the amino acid sequences of SEQ ID NO.:16 (CDR1), SEQ ID NO.:17 (CDR2) and SEQ ID NO.:18 (CDR3);

(iv) an antigen binding site comprising heavy chain CDRs comprising the amino acid sequences of SEQ ID NO.: 13 (CDR1), SEQ ID NO.:19 (CDR2) and SEQ ID NO.:15 (CDR3) and light chain CDRs comprising the amino acid sequences of SEQ ID NO.:20 (CDR1), SEQ ID NO.:17 (CDR2) and SEQ ID NO.:18 (CDR3);

(v) an antigen binding site comprising heavy chain CDRs comprising the amino acid sequences of SEQ ID NO.: 21 (CDR1), SEQ ID NO.:22 (CDR2) and SEQ ID NO.:23 (CDR3) and light chain CDRs comprising the amino acid sequences of SEQ ID NO.:24 (CDR1), SEQ ID NO.:25 (CDR2) and SEQ ID NO.:26 (CDR3); and (vi) an antigen binding site comprising heavy chain CDRs comprising the amino acid sequences of SEQ ID NO.: 27 (CDR1), SEQ ID NO.:28 (CDR2) and SEQ ID NO.:29 (CDR3) and light chain CDRs comprising the amino acid sequences of SEQ ID NO.:30 (CDR1), SEQ ID NO.:25 (CDR2) and SEQ ID NO.:31 (CDR3).

The CDRs disclosed herein and depicted in SEQ ID NO: 1 to 31 are presented according to the Kabat nomenclature, and are shown in table 1 below. As used herein, HCDR stands for heavy chain CDR and LCDR for light chain CDR.

As additional nomenclatures are known in the art, the CDR sequences based on the most commonly used of these nomenclatures are shown in table 1 below as well, but only for those instances in which the application of these alternative nomenclatures resulted in different amino acid sequences. These numbering systems are based on (i) CCG (Chemical Computing Group as illustrated in Almagro et al., Proteins 2011; 79:3050-3066 and Maier et al, Proteins 2014; 82:1599-1610), (ii) Chothia (Chothia and Lesk, 1987, J. Mol. Biol. 196: 901-917), (iii) IMGT (Lefranc M P, Dev Comp Immunol. 2003 January; 27(1):55-77) and (iv) North (North B, J Mol Biol. (2011) 406:228-56).

The amino acid positions indicated for CDRs herein (see table 1) according to Kabat, CCG, Chothia, IMGT and North positions are linear, i.e. the amino acids of the respective full length molecule chain are consecutively numbered starting from number 1 at the N-terminus and end with the number that corresponds to the total number of amino acids in said molecule. For example, a heavy chain consisting of 118 amino acids in length will start with number 1 at the N-terminus and will end with number 118 at the most C-terminal amino acid. Thus, any reference to e.g. position 25 means that the amino acid number 25 as counted from the N-terminus of this molecule is referred to.

In a more preferred embodiment of the binding molecule of the present invention, the at least one antigen binding site that binds specifically to TROP2 is selected from the group consisting of antigen binding sites (i) to (xii):

(i) an antigen binding site comprising an immunoglobulin heavy chain variable domain comprising the amino acid sequence of SEQ ID NO:83 and an immunoglobulin light chain variable domain comprising the amino acid sequence of SEQ ID NO:84;

(ii) an antigen binding site comprising an immunoglobulin heavy chain variable domain comprising the amino acid sequence of SEQ ID NO:85 and an immunoglobulin light chain variable domain comprising the amino acid sequence of SEQ ID NO:86;

(iii) an antigen binding site comprising an immunoglobulin heavy chain variable domain comprising the amino acid sequence of SEQ ID NO:87 and an immunoglobulin light chain variable domain comprising the amino acid sequence of SEQ ID NO:88;

(iv) an antigen binding site comprising an immunoglobulin heavy chain variable domain comprising the amino acid sequence of SEQ ID NO:89 and an immunoglobulin light chain variable domain comprising the amino acid sequence of SEQ ID NO:90;

(v) an antigen binding site comprising an immunoglobulin heavy chain variable domain comprising the amino acid sequence of SEQ ID NO:91 and an immunoglobulin light chain variable domain comprising the amino acid sequence of SEQ ID NO:92;

(vi) an antigen binding site comprising an immunoglobulin heavy chain variable domain comprising the amino acid sequence of SEQ ID NO:93 and an immunoglobulin light chain variable domain comprising the amino acid sequence of SEQ ID NO:94;

(vii) an antigen binding site comprising an immunoglobulin heavy chain variable domain comprising the amino acid sequence of SEQ ID NO:95 and an immunoglobulin light chain variable domain comprising the amino acid sequence of SEQ ID NO:94;

(viii) an antigen binding site comprising an immunoglobulin heavy chain variable domain comprising the amino acid sequence of SEQ ID NO:95 and an immunoglobulin light chain variable domain comprising the amino acid sequence of SEQ ID NO:96;

(ix) an antigen binding site comprising an immunoglobulin heavy chain variable domain comprising the amino acid sequence of SEQ ID NO:95 and an immunoglobulin light chain variable domain comprising the amino acid sequence of SEQ ID NO:97;

(x) an antigen binding site comprising an immunoglobulin heavy chain variable domain comprising the amino acid sequence of SEQ ID NO:98 and an immunoglobulin light chain variable domain comprising the amino acid sequence of SEQ ID NO:97;

(xi) an antigen binding site comprising an immunoglobulin heavy chain variable domain comprising the amino acid sequence of SEQ ID NO:95 and an immunoglobulin light chain variable domain comprising the amino acid sequence of SEQ ID NO:99;

or (xii) an antigen binding site comprising an immunoglobulin heavy chain variable domain comprising the amino acid sequence of SEQ ID NO:98 and an immunoglobulin light chain variable domain comprising the amino acid sequence of SEQ ID NO:96.

In accordance with the present invention, the terms "immunoglobulin heavy chain variable domain" and "immunoglobulin light chain variable domain" are used in accordance with the definitions in the art.

In another preferred embodiment of the binding molecule of the present invention, the at least one antigen binding site that binds specifically to CDH17 is selected from the group consisting of antigen binding sites (i) to (ii):

(i) an antigen binding site comprising heavy chain CDRs comprising the amino acid sequences of SEQ ID NO.: 32 (CDR1), SEQ ID NO.:33 (CDR2) and SEQ ID NO.:34 (CDR3) and light chain CDRs comprising the amino acid sequences of SEQ ID NO.:35 (CDR1), SEQ ID NO.:36 (CDR2) and SEQ ID NO.:37 (CDR3); and (ii) an antigen binding site comprising heavy chain CDRs comprising the amino acid sequences of SEQ ID NO.: 32 (CDR1), SEQ ID NO.:38 (CDR2) and SEQ ID NO.:34 (CDR3) and light chain CDRs comprising the amino acid sequences of SEQ ID NO.:39 (CDR1), SEQ ID NO.:40 (CDR2) and SEQ ID NO.:37 (CDR3).

Also the CDRs disclosed herein and depicted in SEQ ID NO:32 to 40 are presented according to the Kabat nomenclature, and are shown in table 1 below. Again, as additional nomenclatures are known in the art, the CDR sequences based on the most commonly used of these nomenclatures are shown in table 1 below as well, but only for those instances in which the application of these alternative nomenclatures resulted in different amino acid sequences.

In a more preferred embodiment of the binding molecule of the present invention, the at least one antigen binding site that binds specifically to CDH17 is selected from the group consisting of antigen binding sites (i) to (ii):

(i) an antigen binding site comprising an immunoglobulin heavy chain variable domain comprising the amino acid sequence of SEQ ID NO:100 and an immunoglobulin light chain variable domain comprising the amino acid sequence of SEQ ID NO:101;

and (ii) an antigen binding site comprising an immunoglobulin heavy chain variable domain comprising the amino acid sequence of SEQ ID NO:102 and an immunoglobulin light chain variable domain comprising the amino acid sequence of SEQ ID NO:103.

In a preferred embodiment of the binding molecule of the present invention, (a) said at least one antigen binding site that binds specifically to TROP2 is comprised in a first polypeptide comprising a first immunoglobulin heavy chain constant CH1 domain, a first immunoglobulin heavy chain variable domain, optionally a first linker, a first immunoglobulin light chain constant domain and a first immunoglobulin light chain variable domain, and/or (b) said at least one antigen binding site that binds specifically to CDH17 is comprised in a second polypeptide comprising a second immunoglobulin heavy chain constant CH1 domain, a second immunoglobulin heavy chain variable domain, optionally a second linker, a second immunoglobulin light chain constant domain and a second immunoglobulin light chain variable domain.

In accordance with the present invention, also the terms "immunoglobulin heavy chain constant CH1 domain" and "immunoglobulin light chain constant domain" are used in accordance with the definitions in the art. Preferably, the order recited above is from the N-terminus to the C-terminus.

The terms "first" and "second", as well as the term "third" further below, as used herein in the context of certain polypeptides and immunoglobulin chains are solely intended to indicate that these molecules are different molecules (as they bind to different target antigens). Thus, these terms shall not be understood to refer to the exact order or sequence of the polypeptides or immunoglobulin chains within the binding protein of the invention. Instead, the term "first" is used when referring to aspects related to binding to TROP2, the term "second" is used when referring to aspects related to binding to CDH17 and the term "third" is used when referring to aspects related to binding to CD3.

The term linker has been defined herein above and suitable linkers have been described in the art. In a preferred embodiment of the binding molecule of the present invention, the first and/or the second linker comprises the amino acid sequence of any one of SEQ ID NO:265, SEQ ID NO:266, SEQ ID NO:273, SEQ ID NO:274 or SEQ ID NO:275. More preferably the first and/or the second linker comprises the amino acid sequence of SEQ ID NO:266.

In accordance with this embodiment of the binding molecule of the present invention, the antigen binding sites for TROP2 and/or CDH17 are selected from the antigen binding sites described herein above, whereas the antigen binding site for CD3 is chosen by the skilled person either from those CD3-specific antigen binding sites available in the art or from those disclosed herein. More preferably, the CD3-specific antigen binding site is selected from one of the scFv sequences (SEQ ID Nos:222 to 264, preferably SEQ ID Nos:222 to 245, more preferably SEQ ID Nos:222 to 224) defined herein below.

The binding molecule of the present invention may, and preferably does, contain an Fc portion. The term Fc portion is known in the art and has been defined herein above. The Fc region of a naturally occurring immunoglobulin molecule typically interacts with a number of Fc receptors, which results in a number of important functional capabilities (which are referred to as "effector functions"). In accordance with the present invention, it is preferred that the binding molecule of the present invention contains an Fc region, or a portion of the Fc region, that does not interfere with the specific binding of the binding molecule of the present invention to the relevant portions of the target antigens. Further, the skilled person is well aware that the choice of the type and length of the constant region depends on whether effector functions like complement fixation or antibody-dependent cell-mediated cytotoxicity are desirable features, and on the desired pharmacological properties of the antibody protein.

Thus, in a preferred embodiment of the binding molecule of the present invention, the binding molecule has an Fc region, or the relevant section thereof, that has been engineered to avoid unintended cross-linking by soluble Fc gamma receptors and/or complement C1q. Preferably, such a binding molecule has much lower affinities to Fc gamma receptors and/or complement C1q than the non-engineered binding molecule (i.e. the non-Fc-engineered binding molecule from which the mutated (engineered) molecule is derived). Such an immunoglobulin molecule is often also referred to as Ig(KO).

In a particularly preferred embodiment of the binding molecule of the present invention, binding to complement product C1q or Fc gamma receptor by the binding molecule in this invention is ablated by utilization of the IgG4 constant region or of the IgG1 constant region with directed L to A mutagenesis at positions 234 and 235 (the so-called "LA-LA mutation"; Hezareh et al., J. Virology 75 (2001) 12161-12168). Preferably, the binding molecule of the present invention contains said L to A mutagenesis.

In another preferred embodiment of the binding molecule of the present invention, the binding molecule comprises an Fc region, or the relevant section thereof, that has been engineered to modify serum levels (half-life) by optimising its interaction with the neonatal Fc receptor (FcRn), e.g. by a point mutation in the CH2 domain at position H310A (according to the EU numbering scheme). Such an Ig molecule is referred to herein as IgFcRnmut.

One challenge in the design of multimeric binding molecules is their production on an industrial scale without random chain pairing and other mismatches. The skilled person is aware of numerous approaches for trying to prevent in particular the formation of heavy chain homodimers, including e.g. the so called knob-in-hole (KiH) strategy, the use of opposite charges to create electrostatic steering effects, or hydrophobic mutations that promote heavy chain heterodimerization, the CH3 strand-exchange engineered domains (SEED Technology) and the fusion of a heterodimeric module such as a cleavable leucine zipper in the C-terminus of the CH3 domain (LUZ-Y technology), as recently summarised in Amaral et al. (J Appl Bioanal 6(1), 26-51 (2020)).

Thus, it is particularly preferred that the binding molecule of the present invention contains at least mutations that result in a knob-in-hole formation. Preferably, the binding molecule of the present invention is based on a modified immunoglobulin molecule, wherein the heavy chains of the Ig molecule part comprise the following mutations:
  (i) the first heavy chain comprises a tryptophan (W) at position 366 [T366W], and the second heavy chain comprises a serine (S) at position 366 [T366S], an alanine (A) at position 368 [L368A] and a valine (V) at position 407 [Y407V];
  (ii) the first heavy chain comprises a tyrosine (Y) at position 366 [T366Y], and the second heavy chain comprises a threonine (T) at position 407 [Y407T];
  (iii) the second heavy chain comprises a tryptophan (W) at position 366 [T366W], and the first heavy chain comprises a serine (5) at position 366 [T366S], an alanine (A) at position 368 [L368A] and a valine (V) at position 407 [Y407V]; or
  (iv) the second heavy chain comprises a tyrosine (Y) at position 366 [T366Y], and the first heavy chain comprises a threonine (T) at position 407 [Y407T],
  and, more preferably, wherein the part of the immunoglobulin molecule that contains the first heavy chain is the part that also contains the antigen binding sites that specifically binds to TROP2 (herein also referred to as the TROP2-binding part of the Ig molecule) and the part of the immunoglobulin molecule that contains the second heavy chain is the part that also contains the antigen binding sites that specifically binds to CDH17 (herein also referred to as the CDH17-binding part of the Ig molecule).

In accordance with this preferred embodiment, the numbering is based on the respective heavy chain, with the first amino acid at the N terminus of said constant region of the heavy chain being position 118 according to the EU numbering scheme. In other words, the tryptophan at position 366 is the 366th amino acid within the heavy chain constant region, starting from the N terminus at position 118. This numbering is well known to the skilled person and is also described in the literatures, see e.g. the IMGT Scientific chart with reference to the EU numbering system for CH1, where for IgG1 the constant region starts at "A" at amino acid 118 according to Edelman, G. M. et al., Proc. Natl. Acad. USA, 63, 78-85 (1969).

Preferably, the binding molecule of the present invention comprises the mutations cited in (i) above, i.e one binding part of the Ig molecule contains the knob-mutation (T366W), while the other binding part of the Ig molecule contains the hole-mutations (T366S, L368A and Y407V). More preferably, the TROP2-binding part of the Ig molecule contains the knob-mutation (T366W), while the CDH17-binding part of the Ig molecule contains the hole-mutations (T366S, L368A and Y407V). The skilled person knows how to combine the target-specific antigen binding sites described herein (preferably a target-specific binding site comprising or consisting of a single chain Fab) with an Fc domain comprising such knob or hole mutations; for example, the Fc domains shown in SEQ ID Nos: 434 and 435 can be employed to place any antigen binding site of interest, preferably a Fab, into the desired knob or hole context.

In an even more preferred embodiment of the binding molecule of the present invention, the heavy chain containing the hole-mutations additionally further comprises the following mutations:
  v) an arginine at position 435 [H435R] and a phenylalanine at position 436 [Y436F] (leading to the removal of a protein A binding site); and/or
  vi) an alanine at position 234 [L234A] and at position 235 [L235A], as discussed above.

The same considerations regarding numbering as defined above apply mutatis mutandis. Further mutations that can be applied by the skilled person are well known in the art and have been described, e.g. in Saunders K O (2019). Front. Immunol. 10:1296.

In an even more preferred embodiment of the binding molecule of the present invention, the binding molecule comprises
  (a-i) an immunoglobulin light chain comprising the amino acid sequence of SEQ ID NO:169 and an immunoglobulin heavy chain comprising the amino acid sequence of SEQ ID NO:170;
  (a-ii) an immunoglobulin light chain comprising the amino acid sequence of SEQ ID NO:171 and an immunoglobulin heavy chain comprising the amino acid sequence of SEQ ID NO:172;
  (a-iii) an immunoglobulin light chain comprising the amino acid sequence of SEQ ID NO:173 and an immunoglobulin heavy chain comprising the amino acid sequence of SEQ ID NO:174;
  (a-iv) an immunoglobulin light chain comprising the amino acid sequence of SEQ ID NO:175 and an immunoglobulin heavy chain comprising the amino acid sequence of SEQ ID NO:176;
  (a-v) an immunoglobulin light chain comprising the amino acid sequence of SEQ ID NO:177 and an immunoglobulin heavy chain comprising the amino acid sequence of SEQ ID NO:178;

(a-vi) an immunoglobulin light chain comprising the amino acid sequence of SEQ ID NO:179 and an immunoglobulin heavy chain comprising the amino acid sequence of SEQ ID NO:180;
(a-vii) an immunoglobulin light chain comprising the amino acid sequence of SEQ ID NO:181 and an immunoglobulin heavy chain comprising the amino acid sequence of SEQ ID NO:182;
(a-viii) an immunoglobulin light chain comprising the amino acid sequence of SEQ ID NO:183 and an immunoglobulin heavy chain comprising the amino acid sequence of SEQ ID NO:184;
(a-ix) an immunoglobulin light chain comprising the amino acid sequence of SEQ ID NO:185 and an immunoglobulin heavy chain comprising the amino acid sequence of SEQ ID NO:186;
(a-x) an immunoglobulin light chain comprising the amino acid sequence of SEQ ID NO:187 and an immunoglobulin heavy chain comprising the amino acid sequence of SEQ ID NO:188;
(a-xi) an immunoglobulin light chain comprising the amino acid sequence of SEQ ID NO:189 and an immunoglobulin heavy chain comprising the amino acid sequence of SEQ ID NO:190; or
(a-xii) an immunoglobulin light chain comprising the amino acid sequence of SEQ ID NO:191 and an immunoglobulin heavy chain comprising the amino acid sequence of SEQ ID NO:192;
and/or
(b-i) an immunoglobulin light chain comprising the amino acid sequence of SEQ ID NO:196 and an immunoglobulin heavy chain comprising the amino acid sequence of SEQ ID NO:197; or
(b-ii) an immunoglobulin heavy chain comprising the amino acid sequence of SEQ ID NO:198 and an immunoglobulin light chain comprising the amino acid sequence of SEQ ID NO:199.

In accordance with the present invention, the terms "immunoglobulin heavy chain" and "immunoglobulin light chain" are used in accordance with the definitions in the art. Thus, these terms relate to the respective chains or domains of an IgG, for example an IgG1, IgG2 or IgG4.

In particular, an immunoglobulin heavy chain typically comprises, in the recited order, a heavy chain variable domain VH, a first heavy chain constant CH1 domain, and an Fc domain, comprising a hinge region and two constant domains ($CH_2$ and $CH_3$), whereas an immunoglobulin light chain typically comprises, in the recited order, a light chain variable domain VL and a first light chain constant CL1 domain.

In accordance with this embodiment of the binding molecule of the present invention, the antigen binding sites for TROP2 and/or CDH17 are comprised in the specific sequences recited above, whereas the antigen binding site for CD3 is chosen by the skilled person either from those CD3-specific antigen binding sites available in the art or from those disclosed herein. More preferably, the CD3-specific antigen binding site is selected from one of the scFv sequences (SEQ ID Nos:222 to 264, preferably SEQ ID Nos:222 to 245, more preferably SEQ ID Nos:222 to 224)) defined herein below.

In yet a further more preferred embodiment of the binding molecule of the present invention, the binding molecule comprises an immunoglobulin molecule comprising at least a first and a second polypeptide, wherein
(a) said first polypeptide binds specifically to TROP2 and comprises the immunoglobulin heavy chain and immunoglobulin light chain combinations as defined herein above in (a-i) to (a-xii), optionally linked by a first linker, and
(b) said second polypeptide binds specifically to CDH17 and comprises the immunoglobulin heavy chain and immunoglobulin light chain combinations as defined herein above in (b-i) to (b-ii), optionally linked by a second linker.

The term linker has been defined herein above and suitable linkers have been described in the art. In a preferred embodiment of the binding molecule of the present invention, comprises the amino acid sequence of any one of SEQ ID NO:265, SEQ ID NO:266, SEQ ID NO:273, SEQ ID NO:274 or SEQ ID NO:275. More preferably the first and/or the second linker comprises the amino acid sequence of SEQ ID NO:266.

Also in accordance with this embodiment of the binding molecule of the present invention, the antigen binding sites for TROP2 and CDH17 are comprised in the specific sequences recited above, whereas the antigen binding site for CD3 is chosen by the skilled person either from those CD3-specific antigen binding sites available in the art or from those disclosed herein. More preferably, the CD3-specific antigen binding site is selected from one of the scFv sequences (SEQ ID Nos:222 to 264, preferably SEQ ID Nos:222 to 245, more preferably SEQ ID Nos:222 to 224) defined herein below.

In a yet more preferred embodiment of the binding molecule of the present invention, the binding molecule comprises
(a-i) the amino acid sequence of SEQ ID NO:200;
(a-ii) the amino acid sequence of SEQ ID NO:207;
(a-iii) the amino acid sequence of SEQ ID NO:208;
(a-iv) the amino acid sequence of SEQ ID NO:209;
(a-v) the amino acid sequence of SEQ ID NO:210;
(a-vi) the amino acid sequence of SEQ ID NO:211;
(a-vii) the amino acid sequence of SEQ ID NO:212;
(a-viii) the amino acid sequence of SEQ ID NO:213;
(a-ix) the amino acid sequence of SEQ ID NO:214;
(a-x) the amino acid sequence of SEQ ID NO:215;
(a-xi) the amino acid sequence of SEQ ID NO:216; or
(a-xii) the amino acid sequence of SEQ ID NO:217;
and/or
(b-i) the amino acid sequence of SEQ ID NO:220; or
(b-ii) the amino acid sequence of SEQ ID NO:221.

Also in accordance with this embodiment of the binding molecule of the present invention, the antigen binding sites for TROP2 and CDH17 are comprised in the specific sequences recited above, whereas the antigen binding site for CD3 is chosen by the skilled person either from those CD3-specific antigen binding sites available in the art or from those disclosed herein. More preferably, the CD3-specific antigen binding site is selected from one of the scFv sequences (SEQ ID Nos:222 to 264) defined herein below. Even more preferably, the CD3-specific antigen binding site is selected from one of the scFv sequences of SEQ ID Nos:222 to 245. Yet even more preferably, the CD3-specific antigen binding site is selected from one of the scFv sequences of SEQ ID Nos:222 to 224.

In a further preferred embodiment of the binding molecule of the present invention, the at least one antigen binding site that binds specifically to CD3 is selected from the group consisting of antigen binding sites (i) to (xxxi):
(i) an antigen binding site comprising heavy chain CDRs comprising the amino acid sequences of SEQ ID NO.: 41 (CDR1), SEQ ID NO.:42 (CDR2) and SEQ ID NO.:43 (CDR3) and light chain CDRs comprising the amino acid sequences of SEQ ID NO.:44 (CDR1), SEQ ID NO.:45 (CDR2) and SEQ ID NO.:47 (CDR3);
(ii) an antigen binding site comprising heavy chain CDRs comprising the amino acid sequences of SEQ ID NO.:41 (CDR1), SEQ ID NO.:42 (CDR2) and SEQ ID NO.:43 (CDR3) and light chain CDRs comprising the amino acid sequences of SEQ ID NO.:44 (CDR1), SEQ ID NO.:45 (CDR2) and SEQ ID NO.:46 (CDR3);
(iii) an antigen binding site comprising heavy chain CDRs comprising the amino acid sequences of SEQ ID NO.:41 (CDR1), SEQ ID NO.:48 (CDR2) and SEQ ID NO.:43 (CDR3) and light chain CDRs comprising the amino acid sequences of SEQ ID NO.:44 (CDR1), SEQ ID NO.:45 (CDR2) and SEQ ID NO.:47 (CDR3);
(iv) an antigen binding site comprising heavy chain CDRs comprising the amino acid sequences of SEQ ID NO.:41 (CDR1), SEQ ID NO.:42 (CDR2) and SEQ ID NO.:49 (CDR3) and light chain CDRs comprising the amino acid sequences of SEQ ID NO.:50 (CDR1), SEQ ID NO.:45 (CDR2) and SEQ ID NO.:51 (CDR3);
(v) an antigen binding site comprising heavy chain CDRs comprising the amino acid sequences of SEQ ID NO.:41 (CDR1), SEQ ID NO.:42 (CDR2) and SEQ ID NO.:43 (CDR3) and light chain CDRs comprising the amino acid sequences of SEQ ID NO.:44 (CDR1), SEQ ID NO.:52 (CDR2) and SEQ ID NO.:47 (CDR3);
(vi) an antigen binding site comprising heavy chain CDRs comprising the amino acid sequences of SEQ ID NO.:41 (CDR1), SEQ ID NO.:42 (CDR2) and SEQ ID NO.:49 (CDR3) and light chain CDRs comprising the amino acid sequences of SEQ ID NO.:44 (CDR1), SEQ ID NO.:52 (CDR2) and SEQ ID NO.:47 (CDR3);
(vii) an antigen binding site comprising heavy chain CDRs comprising the amino acid sequences of SEQ ID NO.:41 (CDR1), SEQ ID NO.:42 (CDR2) and SEQ ID NO.:43 (CDR3) and light chain CDRs comprising the amino acid sequences of SEQ ID NO.:53 (CDR1), SEQ ID NO.:52 (CDR2) and SEQ ID NO.:47 (CDR3);
(viii) an antigen binding site comprising heavy chain CDRs comprising the amino acid sequences of SEQ ID NO.:41 (CDR1), SEQ ID NO.:48 (CDR2) and SEQ ID NO.:54 (CDR3) and light chain CDRs comprising the amino acid sequences of SEQ ID NO.:55 (CDR1), SEQ ID NO.:45 (CDR2) and SEQ ID NO.:51 (CDR3);
(ix) an antigen binding site comprising heavy chain CDRs comprising the amino acid sequences of SEQ ID NO.:41 (CDR1), SEQ ID NO.:48 (CDR2) and SEQ ID NO.:54 (CDR3) and light chain CDRs comprising the amino acid sequences of SEQ ID NO.:56 (CDR1), SEQ ID NO.:52 (CDR2) and SEQ ID NO.:51 (CDR3);
(x) an antigen binding site comprising heavy chain CDRs comprising the amino acid sequences of SEQ ID NO.:41 (CDR1), SEQ ID NO.:48 (CDR2) and SEQ ID NO.:54 (CDR3) and light chain CDRs comprising the amino acid sequences of SEQ ID NO.:57 (CDR1), SEQ ID NO.:45 (CDR2) and SEQ ID NO.:51 (CDR3);
(xi) an antigen binding site comprising heavy chain CDRs comprising the amino acid sequences of SEQ ID NO.:41 (CDR1), SEQ ID NO.:58 (CDR2) and SEQ ID NO.:59 (CDR3) and light chain CDRs comprising the amino acid sequences of SEQ ID NO.:60 (CDR1), SEQ ID NO.:45 (CDR2) and SEQ ID NO.:51 (CDR3);
(xii) an antigen binding site comprising heavy chain CDRs comprising the amino acid sequences of SEQ ID NO.:41 (CDR1), SEQ ID NO.:42 (CDR2) and SEQ ID NO.:43 (CDR3) and light chain CDRs comprising the amino acid sequences of SEQ ID NO.:61 (CDR1), SEQ ID NO.:52 (CDR2) and SEQ ID NO.:51 (CDR3);
(xiii) an antigen binding site comprising heavy chain CDRs comprising the amino acid sequences of SEQ ID NO.:41 (CDR1), SEQ ID NO.:62 (CDR2) and SEQ ID NO.:54 (CDR3) and light chain CDRs comprising the amino acid sequences of SEQ ID NO.:57 (CDR1), SEQ ID NO.:45 (CDR2) and SEQ ID NO.:51 (CDR3);
(xiv) an antigen binding site comprising heavy chain CDRs comprising the amino acid sequences of SEQ ID NO.:41 (CDR1), SEQ ID NO.:63 (CDR2) and SEQ ID NO.:54 (CDR3) and light chain CDRs comprising the amino acid sequences of SEQ ID NO.:56 (CDR1), SEQ ID NO.:45 (CDR2) and SEQ ID NO.:51 (CDR3);
(xv) an antigen binding site comprising heavy chain CDRs comprising the amino acid sequences of SEQ ID NO.:41 (CDR1), SEQ ID NO.:42 (CDR2) and SEQ ID NO.:43 (CDR3) and light chain CDRs comprising the amino acid sequences of SEQ ID NO.:61 (CDR1), SEQ ID NO.:45 (CDR2) and SEQ ID NO.:51 (CDR3);
(xvi) an antigen binding site comprising heavy chain CDRs comprising the amino acid sequences of SEQ ID NO.:41 (CDR1), SEQ ID NO.:42 (CDR2) and SEQ ID NO.:43 (CDR3) and light chain CDRs comprising the amino acid sequences of SEQ ID NO.:57 (CDR1), SEQ ID NO.:52 (CDR2) and SEQ ID NO.:51 (CDR3);
(xvii) an antigen binding site comprising heavy chain CDRs comprising the amino acid sequences of SEQ ID NO.:82 (CDR1), SEQ ID NO.:64 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);
(xviii) an antigen binding site comprising heavy chain CDRs comprising the amino acid sequences of SEQ ID NO.:82 (CDR1), SEQ ID NO.:69 (CDR2) and SEQ ID NO.:70 (CDR3) and light chain CDRs comprising the amino acid sequences of SEQ ID NO.:66 (CDR1), SEQ ID NO.:67 (CDR2) and SEQ ID NO.:68 (CDR3);
(xix) an antigen binding site comprising heavy chain CDRs comprising the amino acid sequences of SEQ ID NO.:82 (CDR1), SEQ ID NO.:72 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);
(xx) an antigen binding site comprising heavy chain CDRs comprising the amino acid sequences of SEQ ID NO.:82 (CDR1), SEQ ID NO.:73 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);
(xxi) an antigen binding site comprising heavy chain CDRs comprising the amino acid sequences of SEQ ID NO.:82 (CDR1), SEQ ID NO.:74 (CDR2) and SEQ ID NO.:65 (CDR3) and light chain CDRs comprising the amino acid sequences of SEQ ID NO.:71 (CDR1), SEQ ID NO.:67 (CDR2) and SEQ ID NO.:68 (CDR3);
(xxii) an antigen binding site comprising heavy chain CDRs comprising the amino acid sequences of SEQ ID NO.:82 (CDR1), SEQ ID NO.:73 (CDR2) and SEQ ID NO.:70 (CDR3) and light chain CDRs comprising the amino acid sequences of SEQ ID NO.:71 (CDR1), SEQ ID NO.:67 (CDR2) and SEQ ID NO.:68 (CDR3);
(xxiii) an antigen binding site comprising heavy chain CDRs comprising the amino acid sequences of SEQ ID NO.:82 (CDR1), SEQ ID NO.:75 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);

(xxiv) an antigen binding site comprising heavy chain CDRs comprising the amino acid sequences of SEQ ID NO.:82 (CDR1), SEQ ID NO.:69 (CDR2) and SEQ ID NO.:65 (CDR3) and light chain CDRs comprising the amino acid sequences of SEQ ID NO.:71 (CDR1), SEQ ID NO.:67 (CDR2) and SEQ ID NO.:68 (CDR3);

(xxv) an antigen binding site comprising heavy chain CDRs comprising the amino acid sequences of SEQ ID NO.:82 (CDR1), SEQ ID NO.:76 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);

(xxvi) an antigen binding site comprising heavy chain CDRs comprising the amino acid sequences of SEQ ID NO.:82 (CDR1), SEQ ID NO.:77 (CDR2) and SEQ ID NO.:65 (CDR3) and light chain CDRs comprising the amino acid sequences of SEQ ID NO.:71 (CDR1), SEQ ID NO.:67 (CDR2) and SEQ ID NO.:68 (CDR3);

(xxvii) an antigen binding site comprising heavy chain CDRs comprising the amino acid sequences of SEQ ID NO.:82 (CDR1), SEQ ID NO.:78 (CDR2) and SEQ ID NO.:65 (CDR3) and light chain CDRs comprising the amino acid sequences of SEQ ID NO.:66 (CDR1), SEQ ID NO.:67 (CDR2) and SEQ ID NO.:68 (CDR3);

(xxviii) an antigen binding site comprising heavy chain CDRs comprising the amino acid sequences of SEQ ID NO.:82 (CDR1), SEQ ID NO.:79 (CDR2) and SEQ ID NO.:65 (CDR3) and light chain CDRs comprising the amino acid sequences of SEQ ID NO.:80 (CDR1), SEQ ID NO.:67 (CDR2) and SEQ ID NO.:68 (CDR3);

(xxix) an antigen binding site comprising heavy chain CDRs comprising the amino acid sequences of SEQ ID NO.:82 (CDR1), SEQ ID NO.:81 (CDR2) and SEQ ID NO.:70 (CDR3) and light chain CDRs comprising the amino acid sequences of SEQ ID NO.:66 (CDR1), SEQ ID NO.:67 (CDR2) and SEQ ID NO.:68 (CDR3);

(xxx) an antigen binding site comprising heavy chain CDRs comprising the amino acid sequences of SEQ ID NO.:82 (CDR1), SEQ ID NO.:79 (CDR2) and SEQ ID NO.:65 (CDR3) and light chain CDRs comprising the amino acid sequences of SEQ ID NO.:80 (CDR1), SEQ ID NO.:67 (CDR2) and SEQ ID NO.:68 (CDR3); and (xxxi) an antigen binding site comprising heavy chain CDRs comprising the amino acid sequences of SEQ ID NO.:82 (CDR1), SEQ ID NO.:81 (CDR2) and SEQ ID NO.:70 (CDR3) and light chain CDRs comprising the amino acid sequences of SEQ ID NO.:66 (CDR1), SEQ ID NO.:67 (CDR2) and SEQ ID NO.:68 (CDR3).

The definitions and preferred embodiments recited above in the context of the antigen binding sites for TROP2 and/or CDH17 apply also to this at least one antigen binding site that binds specifically to CD3, unless expressly stated otherwise. In particular, the order of certain elements within the antigen binding sites, the definition of terms that are not TROP2- or CDH17-specific and aspects of general design and architecture of elements of the binding molecule of the present invention also apply to this CD3-specific antigen binding sites. Furthermore, also for this CD3-specific antigen binding site it is preferred that it is entirely composed of amino acids, i.e. that it is comprised in a polypeptide and/or the CDRs are peptides or polypeptides. It will be appreciated that this also means that any linker, if present, is preferably a peptide linker, preferably a flexible linker as defined herein above. Preferably, any such linker comprises the amino acid sequence of any one of SEQ ID NO:265, SEQ ID NO:266, SEQ ID NO:273, SEQ ID NO:274 or SEQ ID NO:275. More preferably the linker comprises the amino acid sequence of SEQ ID NO:265.

Also the CDRs disclosed herein and depicted in SEQ ID NO: 41 to 82 are presented according to the Kabat nomenclature, and are shown in table 1 below. Again, as additional nomenclatures are known in the art, the CDR sequences based on the most commonly used of these nomenclatures are shown in table 1 below as well, but only for those instances in which the application of these alternative nomenclatures resulted in different amino acid sequences.

In a further more preferred embodiment of the binding molecule of the present invention, said at least one antigen binding site that binds specifically to CD3 comprises a third immunoglobulin heavy chain variable domain and a third immunoglobulin light chain variable domain, optionally linked by a third linker.

In a more preferred embodiment of the binding molecule of the present invention, the at least one antigen binding site that binds specifically to CD3 is selected from the group consisting of antigen binding sites (i) to (xvi):

(i) an antigen binding site comprising an immunoglobulin heavy chain variable domain comprising the amino acid sequence of SEQ ID NO:104 and an immunoglobulin light chain variable domain comprising an amino acid sequence selected from the group consisting of SEQ ID NO:105, SEQ ID NO:106, SEQ ID NO:107, SEQ ID NO:109, SEQ ID NO:114, SEQ ID NO:115, SEQ ID NO:116, SEQ ID NO:117, SEQ ID NO:120, SEQ ID NO:121, SEQ ID NO:123, and SEQ ID NO:129;

(ii) an antigen binding site comprising an immunoglobulin heavy chain variable domain comprising the amino acid sequence of SEQ ID NO:110 and an immunoglobulin light chain variable domain comprising the amino acid sequence of SEQ ID NO:111;

(iii) an antigen binding site comprising an immunoglobulin heavy chain variable domain comprising the amino acid sequence of SEQ ID NO:112 and an immunoglobulin light chain variable domain comprising the amino acid sequence of SEQ ID NO:113;

(iv) an antigen binding site comprising an immunoglobulin heavy chain variable domain comprising the amino acid sequence of SEQ ID NO:118 and an immunoglobulin light chain variable domain comprising an amino acid sequence selected from the group consisting of SEQ ID NO:119 and SEQ ID NO:122;

(v) an antigen binding site comprising an immunoglobulin heavy chain variable domain comprising the amino acid sequence of SEQ ID NO:124 and an immunoglobulin light chain variable domain comprising an amino acid sequence selected from the group consisting of SEQ ID NO:125, SEQ ID NO:126 and SEQ ID NO:127;

(v) an antigen binding site comprising an immunoglobulin heavy chain variable domain comprising an amino acid sequence selected from the group consisting of SEQ ID NO:128 and SEQ ID NO:130 and an immunoglobulin light chain variable domain comprising an amino acid sequence of SEQ ID NO:127;

(vi) an antigen binding site comprising an immunoglobulin heavy chain variable domain comprising the amino acid sequence of SEQ ID NO:131 and an immunoglobulin light chain variable domain comprising the amino acid sequence of SEQ ID NO:132;

(vii) an antigen binding site comprising an immunoglobulin heavy chain variable domain comprising the amino acid sequence of SEQ ID NO:133 and an immunoglobulin light chain variable domain comprising an amino acid sequence selected from the group consisting of SEQ ID NO:134 and SEQ ID NO:135;

(viii) an antigen binding site comprising an immunoglobulin heavy chain variable domain comprising the amino acid sequence of SEQ ID NO:136 and an immunoglobulin light chain variable domain comprising the amino acid sequence of SEQ ID NO:137;

(ix) an antigen binding site comprising an immunoglobulin heavy chain variable domain comprising an amino acid sequence selected from the group consisting of SEQ ID NO:138 and SEQ ID NO: 156 and an immunoglobulin light chain variable domain comprising the amino acid sequence of SEQ ID NO:139;

(x) an antigen binding site comprising an immunoglobulin heavy chain variable domain comprising an amino acid sequence selected from the group consisting of SEQ ID NO:140, SEQ ID NO:142, SEQ ID NO:143 and SEQ ID NO:161 and an immunoglobulin light chain variable domain comprising an amino acid sequence of SEQ ID NO:141; (xi) an antigen binding site comprising an immunoglobulin heavy chain variable domain comprising an amino acid sequence selected from the group consisting of SEQ ID NO:144 and SEQ ID NO:146 and an immunoglobulin light chain variable domain comprising an amino acid sequence of SEQ ID NO:145;

(xii) an antigen binding site comprising an immunoglobulin heavy chain variable domain comprising an amino acid sequence selected from the group consisting of SEQ ID NO:147, SEQ ID NO:151, SEQ ID NO:153 and SEQ ID NO:162 and an immunoglobulin light chain variable domain comprising an amino acid sequence of SEQ ID NO:148; (xiii) an antigen binding site comprising an immunoglobulin heavy chain variable domain comprising an amino acid sequence selected from the group consisting of SEQ ID NO:149 and SEQ ID NO:152 and an immunoglobulin light chain variable domain comprising an amino acid sequence of SEQ ID NO:150;

(xiv) an antigen binding site comprising an immunoglobulin heavy chain variable domain comprising the amino acid sequence of SEQ ID NO:154 and an immunoglobulin light chain variable domain comprising the amino acid sequence of SEQ ID NO:155;

(xv) an antigen binding site comprising an immunoglobulin heavy chain variable domain comprising the amino acid sequence of SEQ ID NO:157 and an immunoglobulin light chain variable domain comprising the amino acid sequence of SEQ ID NO:158; and (xvi) an antigen binding site comprising an immunoglobulin heavy chain variable domain comprising the amino acid sequence of SEQ ID NO:159 and an immunoglobulin light chain variable domain comprising the amino acid sequence of SEQ ID NO:160.

It is also preferred that said antigen binding site that binds specifically to CD3 is a single-chain variable fragment (scFv). More preferably, said scFv is arranged such that the heavy chain variable domain is at its N-terminus and the light chain variable domain is at its C-terminus.

Methods of linking polypeptides of interest, including scFv molecules, to e.g. the C-terminus of the heavy chain of an IgG molecule are well known in the art. It will be appreciated that said fusion of the scFv to the Ig molecule can be either a direct fusion or can be via a linker, preferably a peptide linker having a length of 5 to 40 amino acids. More preferably, said peptide linker comprises the amino acid sequence of any one of SEQ ID NO:265, SEQ ID NO:266, SEQ ID NO:273, SEQ ID NO:274 or SEQ ID NO:275. More preferably said linker comprises the amino acid sequence of SEQ ID NO:275. In practice, normally the linkage is achieved by combining the nucleic acid molecule encoding the IgG of interest with the nucleic acid encoding the desired polypeptide, e.g. the scFv, where necessary interspaced by the nucleic acid molecule encoding the linker sequence, thereby forming a single nucleic acid molecule comprising all three elements. Then, this complete HC-scFv encoding nucleic acid molecule is placed within an expression vector and introduced to appropriate host cells such that the complete IgG heavy chain-scFv single polypeptide is formed.

In an even more preferred embodiment of the binding molecule of the present invention, the at least one antigen binding site that binds specifically to CD3 comprises an amino acid sequence selected from the group consisting of SEQ ID NOs: 222 to 264. Even more preferably, the CD3-specific antigen binding site is selected from one of the scFv sequences of SEQ ID Nos:222 to 245. Yet even more preferably, the CD3-specific antigen binding site is selected from one of the scFv sequences of SEQ ID Nos:222 to 224.

As indicated herein above, the numbering (a), (b) and (c) for the antigen binding sites of the binding molecule of the present invention is not intended to indicate any particular order or format.

Figure 3:
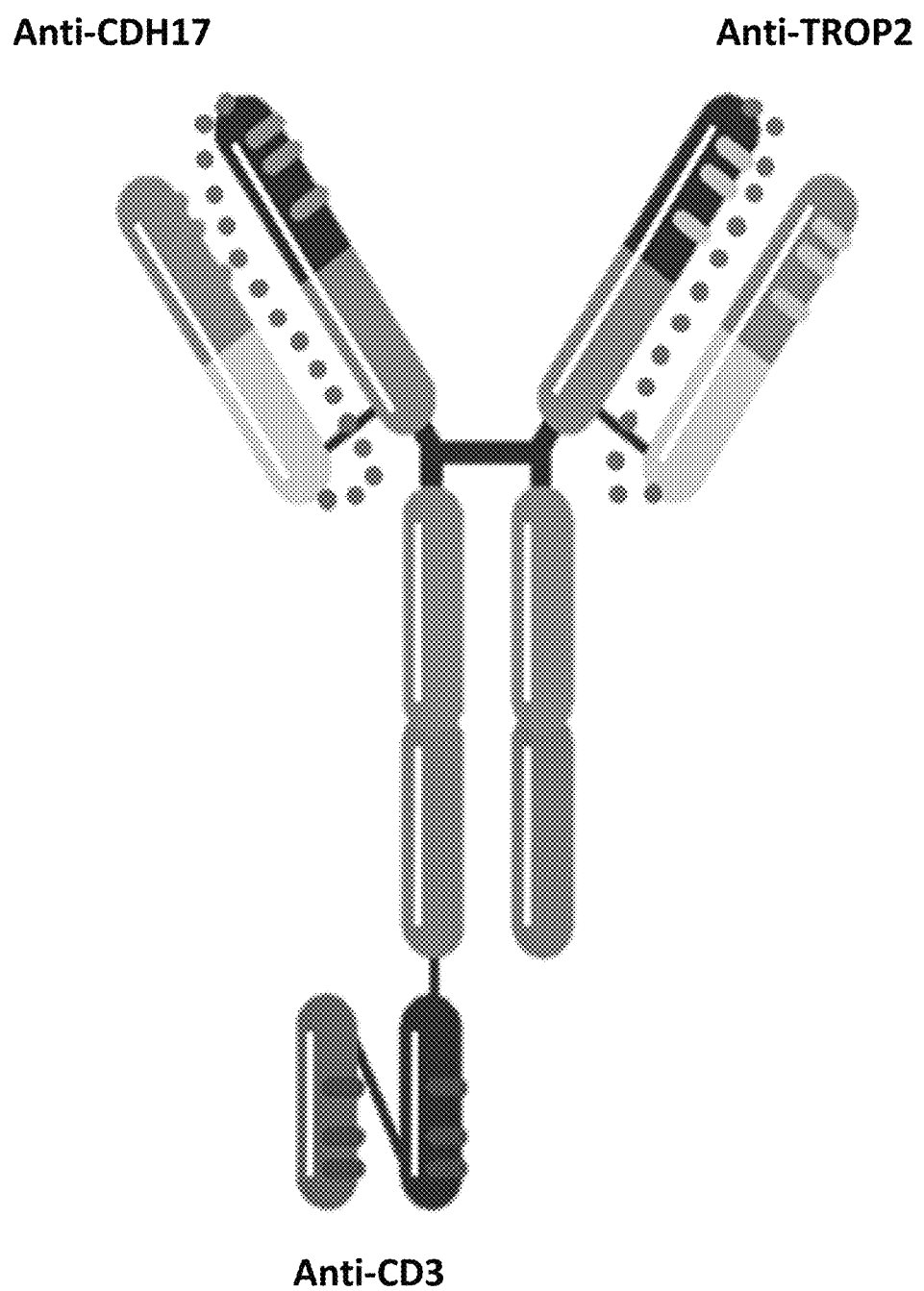
FIG. 3: Schematic representation of an exemplary trispecific binding molecule of the invention.

However, it is preferred that the first antigen binding site that specially binds to TROP2 and the second antigen binding site that specifically binds to CDH17 are both comprised within one immunoglobulin (Ig) molecule, i.e. they are arranged in the format of a conventional IgG antibody, forming a Y-shaped structure, as shown for example in FIG. 3, wherein one half of the Ig molecule (e.g. comprising a first light chain, linked to a first heavy chain) contains the antigen binding site to TROP2 and the second half of the Ig molecule (e.g. comprising a second light chain, linked to second heavy chain) contains the antigen binding site for CDH17. Preferably, said Ig molecule is IgG or has a format derived from IgG. More preferably, said immunoglobulin molecule is modified in that the at least one antigen binding site that specifically binds to CD3, preferably as a single-chain variable fragment (scFv), is fused thereto.

Accordingly, in a particularly preferred embodiment of the binding molecule of the present invention, the binding molecule is a modified immunoglobulin (Ig) molecule, preferably a modified IgG molecule, wherein said at least one antigen binding site that specifically binds to TROP2 and said at least one antigen binding site that specifically binds to CDH17 reside in the variable regions of said Ig molecule, and wherein said at least one antigen binding site that binds specifically to CD3 is at least one scFv fused to said TROP2-CDH17-specific Ig molecule. More preferably, said scFv is fused to the C-terminus of the heavy chain of the Ig molecule, preferably to the C-terminus of only one of the two heavy chains, and more preferably to the heavy chain of the part of the Ig molecule that comprises the at least one antigen binding site that specifically binds to CDH17, as also depicted in FIG. 3.

In a further more preferred embodiment of the binding molecule of the present invention, the binding molecule comprises:
(a) a first immunoglobulin light chain and immunoglobulin heavy chain combination selected from (a-i) to (a-xii):
(a-i) an immunoglobulin light chain comprising the amino acid sequence of SEQ ID NO:169 and an immunoglobulin heavy chain comprising the amino acid sequence of SEQ ID NO:170;
(a-ii) an immunoglobulin light chain comprising the amino acid sequence of SEQ ID NO:171 and an immunoglobulin heavy chain comprising the amino acid sequence of SEQ ID NO:172;
(a-iii) an immunoglobulin light chain comprising the amino acid sequence of SEQ ID NO:173 and an immunoglobulin heavy chain comprising the amino acid sequence of SEQ ID NO:174;
(a-iv) an immunoglobulin light chain comprising the amino acid sequence of SEQ ID NO:175 and an immunoglobulin heavy chain comprising the amino acid sequence of SEQ ID NO:176;
(a-v) an immunoglobulin light chain comprising the amino acid sequence of SEQ ID NO:177 and an immunoglobulin heavy chain comprising the amino acid sequence of SEQ ID NO:178;
(a-vi) an immunoglobulin light chain comprising the amino acid sequence of SEQ ID NO:179 and an immunoglobulin heavy chain comprising the amino acid sequence of SEQ ID NO:180;
(a-vii) an immunoglobulin light chain comprising the amino acid sequence of SEQ ID NO:181 and an immunoglobulin heavy chain comprising the amino acid sequence of SEQ ID NO:182;
(a-viii) an immunoglobulin light chain comprising the amino acid sequence of SEQ ID NO:183 and an immunoglobulin heavy chain comprising the amino acid sequence of SEQ ID NO:184;
(a-ix) an immunoglobulin light chain comprising the amino acid sequence of SEQ ID NO:185 and an immunoglobulin heavy chain comprising the amino acid sequence of SEQ ID NO:186;
(a-x) an immunoglobulin light chain comprising the amino acid sequence of SEQ ID NO:187 and an immunoglobulin heavy chain comprising the amino acid sequence of SEQ ID NO:188;
(a-xi) an immunoglobulin light chain comprising the amino acid sequence of SEQ ID NO:189 and an immunoglobulin heavy chain comprising the amino acid sequence of SEQ ID NO:190; or
(a-xii) an immunoglobulin light chain comprising the amino acid sequence of SEQ ID NO:191 and an immunoglobulin heavy chain comprising the amino acid sequence of SEQ ID NO:192;
and
(b) a second immunoglobulin heavy chain and immunoglobulin light chain combination selected from (b-i) to (b-ii):
(b-i) an immunoglobulin light chain comprising the amino acid sequence of SEQ ID NO:196 and an immunoglobulin heavy chain comprising the amino acid sequence of SEQ ID NO:197; or
(b-ii) an immunoglobulin heavy chain comprising the amino acid sequence of SEQ ID NO:198 and an immunoglobulin light chain comprising the amino acid sequence of SEQ ID NO:199;
and
(c) a single-chain variable fragment (scFv) comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224.

Preferably, said first immunoglobulin heavy chain is fused to the first immunoglobulin light chain via a first linker, preferably the linker of SEQ ID NO:266, and/or said second immunoglobulin heavy chain is fused to the second immunoglobulin light chain via a second linker, preferably the linker of SEQ ID NO:266, and/or said scFv is fused to the C-terminus of the second immunoglobulin heavy chain via a third linker, preferably the linker of SEQ ID NO:275.

In a yet even more preferred embodiment of the binding molecule of the present invention, the binding molecule comprises:
(i) a first polypeptide chain comprising the amino acid sequence of SEQ ID NO.:200, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;
(ii) a first polypeptide chain comprising the amino acid sequence of SEQ ID NO.:200, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;
(iii) a first polypeptide chain comprising the amino acid sequence of SEQ ID NO.:207, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;
(iv) a first polypeptide chain comprising the amino acid sequence of SEQ ID NO.:207, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;
(v) a first polypeptide chain comprising the amino acid sequence of SEQ ID NO.:208, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;
(vi) a first polypeptide chain comprising the amino acid sequence of SEQ ID NO.:208, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(vii) a first polypeptide chain comprising the amino acid sequence of SEQ ID NO.:209, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(viii) a first polypeptide chain comprising the amino acid sequence of SEQ ID NO.:209, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(ix) a first polypeptide chain comprising the amino acid sequence of SEQ ID NO.:210, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(x) a first polypeptide chain comprising the amino acid sequence of SEQ ID NO.:210, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xi) a first polypeptide chain comprising the amino acid sequence of SEQ ID NO.:211, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xii) a first polypeptide chain comprising the amino acid sequence of SEQ ID NO.:211, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xiii) a first polypeptide chain comprising the amino acid sequence of SEQ ID NO.:212, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xiv) a first polypeptide chain comprising the amino acid sequence of SEQ ID NO.:212, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xv) a first polypeptide chain comprising the amino acid sequence of SEQ ID NO.:213, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xvi) a first polypeptide chain comprising the amino acid sequence of SEQ ID NO.:213, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xvii) a first polypeptide chain comprising the amino acid sequence of SEQ ID NO.:214, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xviii) a first polypeptide chain comprising the amino acid sequence of SEQ ID NO.:214, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xix) a first polypeptide chain comprising the amino acid sequence of SEQ ID NO.:215, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xx) a first polypeptide chain comprising the amino acid sequence of SEQ ID NO.:215, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xxi) a first polypeptide chain comprising the amino acid sequence of SEQ ID NO.:216, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xxii) a first polypeptide chain comprising the amino acid sequence of SEQ ID NO.:216, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224;

(xxiii) a first polypeptide chain comprising the amino acid sequence of SEQ ID NO.:217, a second polypeptide chain comprising the amino acid sequence of SEQ ID NO.:220, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224; or (xxiv) a first polypeptide chain comprising the amino acid sequence of SEQ ID NO.:217, a second polypeptide chain comprising the amino acid sequence of SEQ ID NO.:221, and a third polypeptide chain comprising an amino acid sequence selected from the group consisting of SEQ ID NOs: 222 to 264, more preferably from the group consisting of SEQ ID NOs:222 to 245, and even more preferably from the group consisting of SEQ ID Nos:222 to 224.

In an even more preferred embodiment of the binding molecule of the present invention, the binding molecule comprises or consists of a first amino acid sequence selected from the group consisting of SEQ ID NOs:200, 207 to 217 and 436 and a second amino acid sequence selected from the group consisting of SEQ ID NOs:267 to 272, 424 to 427 and 437.

In a yet more preferred embodiment of the binding molecule of the present invention, the binding molecule comprises or consists of:

(a-i) the amino acid sequence of SEQ ID NO.:200 and the amino acid sequence of SEQ ID NO.:267;
(a-ii) the amino acid sequence of SEQ ID NO.:207 and the amino acid sequence of SEQ ID NO.:267;
(a-iii) the amino acid sequence of SEQ ID NO.:208 and the amino acid sequence of SEQ ID NO.:267;
(a-iv) the amino acid sequence of SEQ ID NO.:209 and the amino acid sequence of SEQ ID NO.:267;
(a-v) the amino acid sequence of SEQ ID NO.:210 and the amino acid sequence of SEQ ID NO.:267;
(a-vi) the amino acid sequence of SEQ ID NO.:211 and the amino acid sequence of SEQ ID NO.:267;
(a-vii) the amino acid sequence of SEQ ID NO.:212 and the amino acid sequence of SEQ ID NO.:267;
(a-viii) the amino acid sequence of SEQ ID NO.:213 and the amino acid sequence of SEQ ID NO.:267;
(a-ix) the amino acid sequence of SEQ ID NO.:214 and the amino acid sequence of SEQ ID NO.:267;
(a-x) the amino acid sequence of SEQ ID NO.:215 and the amino acid sequence of SEQ ID NO.:267;
(a-xi) the amino acid sequence of SEQ ID NO.:216 and the amino acid sequence of SEQ ID NO.:267;
(a-xii) the amino acid sequence of SEQ ID NO.:217 and the amino acid sequence of SEQ ID NO.:267;
(b-i) the amino acid sequence of SEQ ID NO.:200 and the amino acid sequence of SEQ ID NO.:268;
(b-ii) the amino acid sequence of SEQ ID NO.:207 and the amino acid sequence of SEQ ID NO.:268;
(b-iii) the amino acid sequence of SEQ ID NO.:208 and the amino acid sequence of SEQ ID NO.:268;
(b-iv) the amino acid sequence of SEQ ID NO.:209 and the amino acid sequence of SEQ ID NO.:268;
(b-v) the amino acid sequence of SEQ ID NO.:210 and the amino acid sequence of SEQ ID NO.:268;
(b-vi) the amino acid sequence of SEQ ID NO.:211 and the amino acid sequence of SEQ ID NO.:268;
(b-vii) the amino acid sequence of SEQ ID NO.:212 and the amino acid sequence of SEQ ID NO.:268;
(b-viii) the amino acid sequence of SEQ ID NO.:213 and the amino acid sequence of SEQ ID NO.:268;
(b-ix) the amino acid sequence of SEQ ID NO.:214 and the amino acid sequence of SEQ ID NO.:268;
(b-x) the amino acid sequence of SEQ ID NO.:215 and the amino acid sequence of SEQ ID NO.:268;
(b-xi) the amino acid sequence of SEQ ID NO.:216 and the amino acid sequence of SEQ ID NO.:268;
(b-xii) the amino acid sequence of SEQ ID NO.:217 and the amino acid sequence of SEQ ID NO.:268;
(c-i) the amino acid sequence of SEQ ID NO.:200 and the amino acid sequence of SEQ ID NO.:269;
(c-ii) the amino acid sequence of SEQ ID NO.:207 and the amino acid sequence of SEQ ID NO.:269;
(c-iii) the amino acid sequence of SEQ ID NO.:208 and the amino acid sequence of SEQ ID NO.:269;
(c-iv) the amino acid sequence of SEQ ID NO.:209 and the amino acid sequence of SEQ ID NO.:269;
(c-v) the amino acid sequence of SEQ ID NO.:210 and the amino acid sequence of SEQ ID NO.:269;
(c-vi) the amino acid sequence of SEQ ID NO.:211 and the amino acid sequence of SEQ ID NO.:269;
(c-vii) the amino acid sequence of SEQ ID NO.:212 and the amino acid sequence of SEQ ID NO.:269;
(c-viii) the amino acid sequence of SEQ ID NO.:213 and the amino acid sequence of SEQ ID NO.:269;
(c-ix) the amino acid sequence of SEQ ID NO.:214 and the amino acid sequence of SEQ ID NO.:269;
(c-x) the amino acid sequence of SEQ ID NO.:215 and the amino acid sequence of SEQ ID NO.:269;
(c-xi) the amino acid sequence of SEQ ID NO.:216 and the amino acid sequence of SEQ ID NO.:269;
(c-xii) the amino acid sequence of SEQ ID NO.:217 and the amino acid sequence of SEQ ID NO.:269;
(d-i) the amino acid sequence of SEQ ID NO.:200 and the amino acid sequence of SEQ ID NO.:270;
(d-ii) the amino acid sequence of SEQ ID NO.:207 and the amino acid sequence of SEQ ID NO.:270;
(d-iii) the amino acid sequence of SEQ ID NO.:208 and the amino acid sequence of SEQ ID NO.:270;
(d-iv) the amino acid sequence of SEQ ID NO.:209 and the amino acid sequence of SEQ ID NO.:270;
(d-v) the amino acid sequence of SEQ ID NO.:210 and the amino acid sequence of SEQ ID NO.:270;
(d-vi) the amino acid sequence of SEQ ID NO.:211 and the amino acid sequence of SEQ ID NO.:270;
(d-vii) the amino acid sequence of SEQ ID NO.:212 and the amino acid sequence of SEQ ID NO.:270;

(d-viii) the amino acid sequence of SEQ ID NO.:213 and the amino acid sequence of SEQ ID NO.:270;
(d-ix) the amino acid sequence of SEQ ID NO.:214 and the amino acid sequence of SEQ ID NO.:270;
(d-x) the amino acid sequence of SEQ ID NO.:215 and the amino acid sequence of SEQ ID NO.:270;
(d-xi) the amino acid sequence of SEQ ID NO.:216 and the amino acid sequence of SEQ ID NO.:270;
(d-xii) the amino acid sequence of SEQ ID NO.:217 and the amino acid sequence of SEQ ID NO.:270;
(e-i) the amino acid sequence of SEQ ID NO.:200 and the amino acid sequence of SEQ ID NO.:271;
(e-ii) the amino acid sequence of SEQ ID NO.:207 and the amino acid sequence of SEQ ID NO.:271;
(e-iii) the amino acid sequence of SEQ ID NO.:208 and the amino acid sequence of SEQ ID NO.:271;
(e-iv) the amino acid sequence of SEQ ID NO.:209 and the amino acid sequence of SEQ ID NO.:271;
(e-v) the amino acid sequence of SEQ ID NO.:210 and the amino acid sequence of SEQ ID NO.:271;
(e-vi) the amino acid sequence of SEQ ID NO.:211 and the amino acid sequence of SEQ ID NO.:271;
(e-vii) the amino acid sequence of SEQ ID NO.:212 and the amino acid sequence of SEQ ID NO.:271;
(e-viii) the amino acid sequence of SEQ ID NO.:213 and the amino acid sequence of SEQ ID NO.:271;
(e-ix) the amino acid sequence of SEQ ID NO.:214 and the amino acid sequence of SEQ ID NO.:271;
(e-x) the amino acid sequence of SEQ ID NO.:215 and the amino acid sequence of SEQ ID NO.:271;
(e-xi) the amino acid sequence of SEQ ID NO.:216 and the amino acid sequence of SEQ ID NO.:271;
(e-xii) the amino acid sequence of SEQ ID NO.:217 and the amino acid sequence of SEQ ID NO.:271;
(f-i) the amino acid sequence of SEQ ID NO.:200 and the amino acid sequence of SEQ ID NO.:272;
(f-ii) the amino acid sequence of SEQ ID NO.:207 and the amino acid sequence of SEQ ID NO.:272;
(f-iii) the amino acid sequence of SEQ ID NO.:208 and the amino acid sequence of SEQ ID NO.:272;
(f-iv) the amino acid sequence of SEQ ID NO.:209 and the amino acid sequence of SEQ ID NO.:272;
(f-v) the amino acid sequence of SEQ ID NO.:210 and the amino acid sequence of SEQ ID NO.:272;
(f-vi) the amino acid sequence of SEQ ID NO.:211 and the amino acid sequence of SEQ ID NO.:272;
(f-vii) the amino acid sequence of SEQ ID NO.:212 and the amino acid sequence of SEQ ID NO.:272;
(f-viii) the amino acid sequence of SEQ ID NO.:213 and the amino acid sequence of SEQ ID NO.:272;
(f-ix) the amino acid sequence of SEQ ID NO.:214 and the amino acid sequence of SEQ ID NO.:272;
(f-x) the amino acid sequence of SEQ ID NO.:215 and the amino acid sequence of SEQ ID NO.:272;
(f-xi) the amino acid sequence of SEQ ID NO.:216 and the amino acid sequence of SEQ ID NO.:272;
(f-xii) the amino acid sequence of SEQ ID NO.:217 and the amino acid sequence of SEQ ID NO.:272;
(g-i) the amino acid sequence of SEQ ID NO.:200 and the amino acid sequence of SEQ ID NO.:424;
(g-ii) the amino acid sequence of SEQ ID NO.:207 and the amino acid sequence of SEQ ID NO.:424;
(g-iii) the amino acid sequence of SEQ ID NO.:208 and the amino acid sequence of SEQ ID NO.:424;
(g-iv) the amino acid sequence of SEQ ID NO.:209 and the amino acid sequence of SEQ ID NO.:424;
(g-v) the amino acid sequence of SEQ ID NO.:210 and the amino acid sequence of SEQ ID NO.:424;
(g-vi) the amino acid sequence of SEQ ID NO.:211 and the amino acid sequence of SEQ ID NO.:424;
(g-vii) the amino acid sequence of SEQ ID NO.:212 and the amino acid sequence of SEQ ID NO.:424;
(g-viii) the amino acid sequence of SEQ ID NO.:213 and the amino acid sequence of SEQ ID NO.:424;
(g-ix) the amino acid sequence of SEQ ID NO.:214 and the amino acid sequence of SEQ ID NO.:424;
(g-x) the amino acid sequence of SEQ ID NO.:215 and the amino acid sequence of SEQ ID NO.:424;
(g-xi) the amino acid sequence of SEQ ID NO.:216 and the amino acid sequence of SEQ ID NO.:424;
(g-xii) the amino acid sequence of SEQ ID NO.:217 and the amino acid sequence of SEQ ID NO.:424;
(h-i) the amino acid sequence of SEQ ID NO.:200 and the amino acid sequence of SEQ ID NO.:425;
(h-ii) the amino acid sequence of SEQ ID NO.:207 and the amino acid sequence of SEQ ID NO.:425;
(h-iii) the amino acid sequence of SEQ ID NO.:208 and the amino acid sequence of SEQ ID NO.:425;
(h-iv) the amino acid sequence of SEQ ID NO.:209 and the amino acid sequence of SEQ ID NO.:425;
(h-v) the amino acid sequence of SEQ ID NO.:210 and the amino acid sequence of SEQ ID NO.:425;
(h-vi) the amino acid sequence of SEQ ID NO.:211 and the amino acid sequence of SEQ ID NO.:425;
(h-vii) the amino acid sequence of SEQ ID NO.:212 and the amino acid sequence of SEQ ID NO.:425;
(h-viii) the amino acid sequence of SEQ ID NO.:213 and the amino acid sequence of SEQ ID NO.:425;
(h-ix) the amino acid sequence of SEQ ID NO.:214 and the amino acid sequence of SEQ ID NO.:425;
(h-x) the amino acid sequence of SEQ ID NO.:215 and the amino acid sequence of SEQ ID NO.:425;
(h-xi) the amino acid sequence of SEQ ID NO.:216 and the amino acid sequence of SEQ ID NO.:425;
(h-xii) the amino acid sequence of SEQ ID NO.:217 and the amino acid sequence of SEQ ID NO.:425;
(i-i) the amino acid sequence of SEQ ID NO.:200 and the amino acid sequence of SEQ ID NO.:426;
(i-ii) the amino acid sequence of SEQ ID NO.:207 and the amino acid sequence of SEQ ID NO.:426;
(i-iii) the amino acid sequence of SEQ ID NO.:208 and the amino acid sequence of SEQ ID NO.:426;
(i-iv) the amino acid sequence of SEQ ID NO.:209 and the amino acid sequence of SEQ ID NO.:426;
(i-v) the amino acid sequence of SEQ ID NO.:210 and the amino acid sequence of SEQ ID NO.:426;
(i-vi) the amino acid sequence of SEQ ID NO.:211 and the amino acid sequence of SEQ ID NO.:426;
(i-vii) the amino acid sequence of SEQ ID NO.:212 and the amino acid sequence of SEQ ID NO.:426;
(i-viii) the amino acid sequence of SEQ ID NO.:213 and the amino acid sequence of SEQ ID NO.:426;
(i-ix) the amino acid sequence of SEQ ID NO.:214 and the amino acid sequence of SEQ ID NO.:426;
(i-x) the amino acid sequence of SEQ ID NO.:215 and the amino acid sequence of SEQ ID NO.:426;
(i-xi) the amino acid sequence of SEQ ID NO.:216 and the amino acid sequence of SEQ ID NO.:426;
(i-xii) the amino acid sequence of SEQ ID NO.:217 and the amino acid sequence of SEQ ID NO.:426;
(j-i) the amino acid sequence of SEQ ID NO.:200 and the amino acid sequence of SEQ ID NO.:427;

(j-ii) the amino acid sequence of SEQ ID NO.:207 and the amino acid sequence of SEQ ID NO.:427;
(j-iii) the amino acid sequence of SEQ ID NO.:208 and the amino acid sequence of SEQ ID NO.:427;
(j-iv) the amino acid sequence of SEQ ID NO.:209 and the amino acid sequence of SEQ ID NO.:427;
(j-v) the amino acid sequence of SEQ ID NO.:210 and the amino acid sequence of SEQ ID NO.:427;
(j-vi) the amino acid sequence of SEQ ID NO.:211 and the amino acid sequence of SEQ ID NO.:427;
(j-vii) the amino acid sequence of SEQ ID NO.:212 and the amino acid sequence of SEQ ID NO.:427;
(j-viii) the amino acid sequence of SEQ ID NO.:213 and the amino acid sequence of SEQ ID NO.:427;
(j-ix) the amino acid sequence of SEQ ID NO.:214 and the amino acid sequence of SEQ ID NO.:427;
(j-x) the amino acid sequence of SEQ ID NO.:215 and the amino acid sequence of SEQ ID NO.:427;
(j-xi) the amino acid sequence of SEQ ID NO.:216 and the amino acid sequence of SEQ ID NO.:427;
(j-xii) the amino acid sequence of SEQ ID NO.:217 and the amino acid sequence of SEQ ID NO.:427; or
(k) the amino acid sequence of SEQ ID NO.:436 and the amino acid sequence of SEQ ID NO.:437.

In one particularly preferred embodiment, the binding molecule of the present invention comprises the amino acid sequence of SEQ ID NO.:207 and the amino acid sequence of SEQ ID NO.:267. In another particularly preferred embodiment, the binding molecule of the present invention comprises the amino acid sequence of SEQ ID NO.:208 and the amino acid sequence of SEQ ID NO.:267. In another particularly preferred embodiment, the binding molecule of the present invention comprises the amino acid sequence of SEQ ID NO.:209 and the amino acid sequence of SEQ ID NO.:267. In another particularly preferred embodiment, the binding molecule of the present invention comprises the amino acid sequence of SEQ ID NO.:210 and the amino acid sequence of SEQ ID NO.:267. In another particularly preferred embodiment, the binding molecule of the present invention comprises the amino acid sequence of SEQ ID NO.:211 and the amino acid sequence of SEQ ID NO.:271. In another particularly preferred embodiment, the binding molecule of the present invention comprises the amino acid sequence of SEQ ID NO.:212 and the amino acid sequence of SEQ ID NO.:271. In another particularly preferred embodiment, the binding molecule of the present invention comprises the amino acid sequence of SEQ ID NO.:213 and the amino acid sequence of SEQ ID NO.:271. In another particularly preferred embodiment, the binding molecule of the present invention comprises the amino acid sequence of SEQ ID NO.:214 and the amino acid sequence of SEQ ID NO.:271. In another particularly preferred embodiment, the binding molecule of the present invention comprises the amino acid sequence of SEQ ID NO.:215 and the amino acid sequence of SEQ ID NO.:271. In another particularly preferred embodiment, the binding molecule of the present invention comprises the amino acid sequence of SEQ ID NO.:211 and the amino acid sequence of SEQ ID NO.:272. In another particularly preferred embodiment, the binding molecule of the present invention comprises the amino acid sequence of SEQ ID NO.:214 and the amino acid sequence of SEQ ID NO.:272. In another particularly preferred embodiment, the binding molecule of the present invention comprises the amino acid sequence of SEQ ID NO.:216 and the amino acid sequence of SEQ ID NO.:272. In another particularly preferred embodiment, the binding molecule of the present invention comprises the amino acid sequence of SEQ ID NO.:217 and the amino acid sequence of SEQ ID NO.:272. In another particularly preferred embodiment, the binding molecule of the present invention comprises the amino acid sequence of SEQ ID NO.:211 and the amino acid sequence of SEQ ID NO.:424. In another particularly preferred embodiment, the binding molecule of the present invention comprises the amino acid sequence of SEQ ID NO.:211 and the amino acid sequence of SEQ ID NO.:425. In another particularly preferred embodiment, the binding molecule of the present invention comprises the amino acid sequence of SEQ ID NO.:211 and the amino acid sequence of SEQ ID NO.:426. In another particularly preferred embodiment, the binding molecule of the present invention comprises the amino acid sequence of SEQ ID NO.:211 and the amino acid sequence of SEQ ID NO.:427. In another particularly preferred embodiment, the binding molecule of the present invention comprises the amino acid sequence of SEQ ID NO.:436 and the amino acid sequence of SEQ ID NO.:437.

As is shown in the appended examples, these particularly preferred binding molecules of the present invention bind to all three target antigens and, thereby, bring T cells into close proximity with tumor cells carrying both Trop2 and CDH17. Surprisingly, it was found that the incorporation of antigen binding sites with high affinity led to monovalent binding and activity on cells expressing only one of these two targets, thus increasing the risk of unwanted side effects. Thus, the present invention provides tri-specific binding molecule comprising low-affinity binders for the tumor cell antigens. As is evident from the Examples below, these low affinity, high avidity tri-specific binding molecules of the present invention provide superior specificity to target cells.

The present invention further relates to a tri-specific binding molecule comprising or consisting of: (i) the amino acid sequence of SEQ ID NO.:207 and the amino acid sequence of SEQ ID NO.:267; (ii) the amino acid sequence of SEQ ID NO.:208 and the amino acid sequence of SEQ ID NO.:267; (iii) the amino acid sequence of SEQ ID NO.:209 and the amino acid sequence of SEQ ID NO.:267; (iv) the amino acid sequence of SEQ ID NO.:210 and the amino acid sequence of SEQ ID NO.:267; (v) the amino acid sequence of SEQ ID NO.:211 and the amino acid sequence of SEQ ID NO.:271; (vi) the amino acid sequence of SEQ ID NO.:212 and the amino acid sequence of SEQ ID NO.:271; (vii) the amino acid sequence of SEQ ID NO.:213 and the amino acid sequence of SEQ ID NO.:271; (viii) the amino acid sequence of SEQ ID NO.:214 and the amino acid sequence of SEQ ID NO.:271; (ix) the amino acid sequence of SEQ ID NO.:215 and the amino acid sequence of SEQ ID NO.:271; (x) the present invention comprises the amino acid sequence of SEQ ID NO.:211 and the amino acid sequence of SEQ ID NO.:272; (xi) the amino acid sequence of SEQ ID NO.:214 and the amino acid sequence of SEQ ID NO.:272; (xii) the amino acid sequence of SEQ ID NO.:216 and the amino acid sequence of SEQ ID NO.:272; (xiii) the amino acid sequence of SEQ ID NO.:217 and the amino acid sequence of SEQ ID NO.:272; (xiv) the amino acid sequence of SEQ ID NO.:211 and the amino acid sequence of SEQ ID NO.:424; (xv) the amino acid sequence of SEQ ID NO.:211 and the amino acid sequence of SEQ ID NO.:425; (xvi) the amino acid sequence of SEQ ID NO.:211 and the amino acid sequence of SEQ ID NO.:426; (xvii) the amino acid sequence of SEQ ID NO.:211 and the amino acid sequence of SEQ ID NO.:427; or (xviii) the amino acid sequence of SEQ ID NO.:436 and the amino acid sequence of SEQ ID NO.:437.

Table 1 below summarises preferred amino acid sequences of the binding molecules of the present invention, or parts thereof.

TABLE 1

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 1 | Trop2#1 HCDR1 | DYTMH |
| SEQ ID NO: 2 | Trop2#1 HCDR2 | GIYPNYGDTNYNEKFKD |
| SEQ ID NO: 3 | Trop2#1 HCDR3 | KTVLLRLRYFDV |
| SEQ ID NO: 4 | Trop2#1 LCDR1 | RASGNIHNYLA |
| SEQ ID NO: 5 | Trop2#1 LCDR2 | NAITLAD |
| SEQ ID NO: 6 | Trop2#1 LCDR3 | QHFWSTPFT |
| SEQ ID NO: 7 | Trop2#8 HCDR1 | RYSVH |
| SEQ ID NO: 8 | Trop2#8 HCDR2 | MIWGGGSTDYNSDFKP |
| SEQ ID NO: 9 | Trop2#8 HCDR3 | KGSYYTNYGAMDY |
| SEQ ID NO: 10 | Trop2#8 LCDR1 | KASQDINKYIA |
| SEQ ID NO: 11 | Trop2#8 LCDR2 | YTSTLQP |
| SEQ ID NO: 12 | Trop2#8 LCDR3 | LQYDNLWT |
| SEQ ID NO: 13 | Trop2#11, #12, #13, #14, #15, #16, #17, #18 HCDR1 | SGYYWN |
| SEQ ID NO: 14 | Trop2#11 HCDR2 | YISYDGRNNYNPSLKN |
| SEQ ID NO: 15 | Trop2#11, #12, #13, #14, #15, #16, #17, #18 HCDR3 | DTTAYFDY |
| SEQ ID NO: 16 | Trop2#11 LCDR1 | RASESVDSSVNRFMH |
| SEQ ID NO: 17 | Trop2#11, #12, #13, #14, #15, #16, #17, #18 LCDR2 | RASNLES |
| SEQ ID NO: 18 | Trop2#11, #12, #13, #14, #15, #16, #17, #18 LCDR3 | QQSNEDPYT |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 19 | Trop2#12, #13, #14, #15, #16, #17, #18 HCDR2 | YISYSGRNLYNPSLKS |
| SEQ ID NO: 20 | Trop2#12, #13, #14, #15, #16, #17, #18 LCDR1 | RASESVSSSVNRFLH |
| SEQ ID NO: 21 | Trop2#9 HCDR1 | DYYMN |
| SEQ ID NO: 22 | Trop2#9 HCDR2 | YIYPNNGATGYNQKFKG |
| SEQ ID NO: 23 | Trop2#9 HCDR3 | EDSYYYAMDY |
| SEQ ID NO: 24 | Trop2#9 LCDR1 | KSSQSLVHSNGNTFLH |
| SEQ ID NO: 25 | Trop2#9, #10 LCDR2 | KVSNRFS |
| SEQ ID NO: 26 | Trop2#9 LCDR3 | SQSTHVYT |
| SEQ ID NO: 27 | Trop2#10 HCDR1 | NYYIH |
| SEQ ID NO: 28 | Trop2#10 HCDR2 | YIYPGNGATAYNQKFKG |
| SEQ ID NO: 29 | Trop2#10 HCDR3 | EDYYYAMDY |
| SEQ ID NO: 30 | Trop2#10 LCDR1 | RSSQSLVHSNGNTYLH |
| SEQ ID NO: 31 | Trop2#10 LCDR3 | SQSTHVWT |
| SEQ ID NO: 32 | CDH17#1, #8 HCDR1 | DHTIH |
| SEQ ID NO: 33 | CDH17#1 HCDR2 | YIYPRDGSTKYNEKFKG |
| SEQ ID NO: 34 | CDH17#1, #8 HCDR3 | WGYYYGSSRYYFDY |
| SEQ ID NO: 35 | CDH17#1 LCDR1 | KSSQSLLYSSNQKNYLA |
| SEQ ID NO: 36 | CDH17#1 LCDR2 | WASTRES |
| SEQ ID NO: 37 | CDH17#1, #8 LCDR3 | QQYYSYPWT |
| SEQ ID NO: 38 | CDH17#8 HCDR2 | YIYPRLGSTKYAEKFQG |
| SEQ ID NO: 39 | CDH17#8 LCDR1 | RASQSVLYSSNQKQYLA |
| SEQ ID NO: 40 | CDH17#8 LCDR2 | GASTRET |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 41 | all of CD3#1 to #25 HCDR1 | TYAMN |
| SEQ ID NO: 42 | all of CD3#1 to #5, CD3#8 to #16, #21, #24, #25 HCDR2 | RIRSKYNNYATYYADSVKD |
| SEQ ID NO: 43 | all of CD3#1 to #11, #13, #14, #16, #21, #24, #25 HCDR3 | HGNFGNSYVSWFAY |
| SEQ ID NO: 44 | all of CD3#1 to #11, #13, #14, #15 LCDR1 | RSSTGAVTTSNYAN |
| SEQ ID NO: 45 | all of CD3#1 to #13, #17, #19, #20, #22, #23, #24 LCDR2 | GTNKRAP |
| SEQ ID NO: 46 | CD3#2, #11 LCDR3 | ALWYSNKWV |
| SEQ ID NO: 47 | CD3#1, all of CD3#3 to #10, #13 to #16 LCDR3 | ALWYSNLWV |
| SEQ ID NO: 48 | CD3#6, #7, #17, #18, #19 HCDR2 | RIRSKYNNYATYYADSVKG |
| SEQ ID NO: 49 | CD3#12, #15 HCDR3 | HGNFLNSYVSWFAY |
| SEQ ID NO: 50 | CD3#12 LCDR1 | RSSTGAVTTSYYAN |
| SEQ ID NO: 51 | CD3#12 LCDR3 | ALWYSNHWV |
| SEQ ID NO: 52 | CD3#14, #15, #16, #18, #21, #25 LCDR2 | GTNIRAP |
| SEQ ID NO: 53 | CD3#16 LCDR1 | ISSTGAVTTSNYAN |
| SEQ ID NO: 54 | CD3#17, #18, #19, #22, #23 HCDR3 | HGNFIDSYVSWFAY |
| SEQ ID NO: 55 | CD3#17 LCDR1 | GRSTGAVTTSNYAN |
| SEQ ID NO: 56 | CD3#18, #23 LCDR1 | GSSTGAVTTSWYAN |
| SEQ ID NO: 57 | CD3#19, #22, #25 LCDR1 | GSSTGAVTTSNYAN |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 58 | CD3#20 HCDR2 | RIRSIYNNYATYYADSVKG |
| SEQ ID NO: 59 | CD3#20 HCDR3 | HGNFGDSYVSWFAY |
| SEQ ID NO: 60 | CD3#20 LCDR1 | VSSTGAVTTSNYAN |
| SEQ ID NO: 61 | CD3#21, #24 LCDR1 | GSSTGAVTTSYYAN |
| SEQ ID NO: 62 | CD3#22 HCDR2 | RIRSIYNNYATYYADIVKG |
| SEQ ID NO: 63 | CD3#23 HCDR2 | RIRSKYNNYATYYADIVKG |
| SEQ ID NO: 64 | CD3#26, #27 HCDR2 | NINADTGSTNYNEKFKN |
| SEQ ID NO: 65 | CD3#26, #27 HCDR3 | DGYSFYYFDY |
| SEQ ID NO: 66 | all of CD3#26 to #30, #33, #35, #37, #39, #42, #43 LCDR1 | KSSQSLLNSRTRKNYLA |
| SEQ ID NO: 67 | all of CD3#26 to #43 LCDR2 | WASTRKS |
| SEQ ID NO: 68 | all of CD3#26 to #43 LCDR3 | IQSFILRT |
| SEQ ID NO: 69 | CD3#28, #34 HCDR2 | NINASTGSTNYNQKFKG |
| SEQ ID NO: 70 | CD3#28, #32, #39,#42, #43 HCDR3 | DAYSFYYFDY |
| SEQ ID NO: 71 | CD3#31, #32, #34,#36 LCDR1 | KSSQSLLNARTRKNYLA |
| SEQ ID NO: 72 | CD3#29 HCDR2 | NINASTGSTSYAEKFKG |
| SEQ ID NO: 73 | CD3#30, #32 HCDR2 | NINASTGSTNYAQKFQG |
| SEQ ID NO: 74 | CD3#31 HCDR2 | NINASTGSTNYAQKFKG |
| SEQ ID NO: 75 | CD3#33 HCDR2 | NINASTGSTSYNQKFKG |
| SEQ ID NO: 76 | CD3#35 HCDR2 | NINASTGSTSYNQKFQN |
| SEQ ID NO: 77 | CD3#36 HCDR2 | NINASTGSTNYNQKFQN |
| SEQ ID NO: 78 | CD3#37 HCDR2 | NINASTGSTSYAQKFKG |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 79 | CD3#38, #40, #41 HCDR2 | NINADTGSTKYNQKFKG |
| SEQ ID NO: 80 | CD3#38, #40, #41 LCDR1 | RSSQSLLNSRTRKNYLA |
| SEQ ID NO: 81 | CD3#39, #42, #43 HCDR2 | NINADTGSTNYNQKFQG |
| SEQ ID NO: 82 | all of CD3#26 to #43 HCDR1 | SYWMH |
| SEQ ID NO: 83 | Trop2#1 VH | EVQLQQSGPELLKPGASVKISCKASGYTFTDYTMHWVKQSHGKS LEWIGGIYPNYGDTNYNEKFKDKATLTVDESSSTAYMELRSLTSE DSAVYYCSRKTVLLRLRYFDVWGTGTTVTVSS |
| SEQ ID NO: 84 | Trop2#1 VL | DIQMTQSPASLSASVGETVTITCRASGNIHNYLAWYQQKQGKSP QLLVYNAITLADGVPSRFSGSGSGTQYSLKINSLQPEDFGSYYCQ HFWSTPFTFGSGTKLEIK |
| SEQ ID NO: 85 | Trop2#8 VH | QVQLKESGPGLVAPSQSLSITCTVSGLSLSRYSVHWVRQPPGKG LEWLGMIWGGGSTDYNSDFKPRLSISKDNSKSQVFLKMNSLQTD DTAMYYCARKGSYYTNYGAMDYWGQGTSVTVSS |
| SEQ ID NO: 86 | Trop2#8 VL | DIQMTQSPSSLSASLGGKVTITCKASQDINKYIAWYQHKPGKGPR LLIHYTSTLQPGIPSRFSGSGSGRDYSFSISNLEPEDIATYYCLQY DNLWTFGGGTKLEIK |
| SEQ ID NO: 87 | Trop2#9 VH | EVQLQQSGPEPVKPGASVKMSCKASGYTFTDYYMNWVKQSHG KSLEWIGYIYPNNGATGYNQKFKGKATLTVDKSSSTAYMELRSLT SEDSAVYYCAREDSYYYAMDYWGQGTSVTVSS |
| SEQ ID NO: 88 | Trop2#9 VL | DVVMTQTPLSLPVSLGDQASISCKSSQSLVHSNGNTFLHWYLQK PGQSPKLLIYKVSNRFSGVPDRFSGSGSGTDFTLKINRVEAEDLG VYFCSQSTHVYTFGGGTKLEIK |
| SEQ ID NO: 89 | Trop2#10 VH | QIQLQQSGPELVKPGAPVKISCKASGYTFTNYYIHWVKQRPGQG LEWIGYIYPGNGATAYNQKFKGKATLTADNPSSTAYMQLSSLTSE DSAVYFCAREDYYYAMDYWGQGTSVTVSS |
| SEQ ID NO: 90 | Trop2#10 VL | VVMTQTPLSLPVSLGDQASISCRSSQSLVHSNGNTYLHWYLQKP GQSPKLLIYKVSNRFSGVPDRFSGSGSGTDFTLKISRVEAEDLGV YFCSQSTHVWTFGGGTKLEIK |
| SEQ ID NO: 91 | Trop2#11 VH | DVQLQESGPGLVKPSQSLSLTCSVTGYSITSGYYWNWIRQFPGN KLEWMGYISYDGRNNYNPSLKNRISITRDTSENQFFLKLNSVTPE DTATYYCARDTTAYFDYWGQGTTLTVSS |
| SEQ ID NO: 92 | Trop2#11 VL | DIVLTQSPPSLAVSLGQRATISCRASESVDSSVNRFMHWYQQKP GQPPKLLIYRASNLESGIPARFSGSGSRTDFTLTINPVEADDVATY YCQQSNEDPYTFGGGTKLEIK |
| SEQ ID NO: 93 | Trop2#12 VH | DVLMTQTPLSLPVSLGDQASISCRSSQNIVHSNGNTYLDWYLQK PGQSPKLLIYKVSNRFSGVPDRFSGSGSGTDFTLKISRVEAEDLG VYYCFQGSHVPPTFGAGTKLELK |
| SEQ ID NO: 94 | Trop2#12 and #13 VL | DIQMTQSPSSLSASVGDRVTITCRASESVSSSVNRFLHWYQQKP GKAPKLLIYRASNLESGVPSRFSGSGSGTDFTLTISSLQPEDFATY YCQQSNEDPYTFGGGTKLEIK |
| SEQ ID NO: 95 | Trop2#13, #14, #15 and #17 VH | QVQLQESGPGLVKPSQTLKLTCTVSGYSISSGYYWNWIRQPPGK GLEWIGYISYSGRNLYNPSLKSRVTISRDTSKNQFSLKLSSVTAAD TAVYYCARDTTAYFDYWGQGTLVTVSS |
| SEQ ID NO: 96 | Trop2#14 and #18 VL | DIQMTQSPSSLSASVGDRVTITCRASESVSSSVNRFLHWYQQKP GKAPKLLIYRASNLESGVPSRFSGKGSGTDFTLTISSLQPEDFATY YCQQSNEDPYTFGGGTKLEIK |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 97 | Trop2#15 and #16 VL | DIQMTQSPSSLSASVGDRVTITCRASESVSSSVNRFLHWYQQKP GKAPKLLIYRASNLESGVPSRFSGSGSGTDFTLTIRSLQPEDFATY YCQQSNEDPYTFGGGTKLEIK |
| SEQ ID NO: 98 | Trop2#16 and #18 VH | QVQLQESGPGLVKPSQTLSLTCTVSGYSISSGYYWNWIRQPPGK GLEWIGYISYSGRNLYNPSLKSRVTISRDTSKNQFSLKLSRVTAAD TAVYYCARDTTAYFDYWGQGTLVTVSS |
| SEQ ID NO: 99 | Trop2#17 VL | DIRMTQSPSSLSASVGDRVTITCRASESVSSSVNRFLHWYQQKP GKAPKLLIYRASNLESGVPSRFSGSGSGTDFTLTISSLQPEDFATY YCQQSNEDPYTFGQGTKLEIK |
| SEQ ID NO: 100 | CDH17#1 VH | QVQLQQSDAELVKPGASVKISCKVSGYTFTDHTIHWMKQRPEQG LEWIGYIYPRDGSTKYNEKFKGKATLTADKSSSTAYMQLNSLTSE DSAVYFCARWGYYYGSSRYYFDYWGQGTTLTVSS |
| SEQ ID NO: 101 | CDH17#1 VL | DIVMSQSPSSLAVSVGEKVTMSCKSSQSLLYSSNQKNYLAWYQQ KPGQSPKLLIYWASTRESGVPDRFTGSGSGTDFTLTISSVKAEDL AVYYCQQYYSYPWTFGGGTKLEIK |
| SEQ ID NO: 102 | CDH17#8 VH | QVQLVQSGAEVKKPGSSVKVSCKASGYTFSDHTIHWVRQAPGQ GLEWMGYIYPRLGSTKYAEKFQGRVTITADKSTSTAYMELSSLRS EDTAVYYCARWGYYYGSSRYYFDYWGQGTLVTVSS |
| SEQ ID NO: 103 | CDH17#8 VL | EIVMTQSPATLSVSPGERATLSCRASQSVLYSSNQKQYLAWYQQ KPGQAPRLLIYGASTRETGIPARFSGSGSGTEFTLTISSLQSEDFA VYYCQQYYSYPWTFGQGTKLEIK |
| SEQ ID NO: 104 | All of CD3#1 to #4, #8 to #11, #13, #14, #16, #21 VH | EVQLVESGGGLVQPGGSLKLSCAASGFTFNTYAMNWVRQAPGK GLEWVARIRSKYNNYATYYADSVKDRFTISRDDSKNTAYLQMNN LKTEDTAVYYCVRHGNFGNSYVSWFAYWGQGTLVTVSA |
| SEQ ID NO: 105 | CD3#1 VL | EAVVTQEPSLTVSPGGTVTLTCRSSTGAVTTSNYANWVQEKPGQ LPRGLIGGTNKRAPWVPARFSGSLLGGKAALTLSGAQPEDEAEY FCALWYSNLWVFGGGTKLTVL |
| SEQ ID NO: 106 | CD3#2 VL | EAVVTQEPSLTVSPGGTVTLTCRSSTGAVTTSNYANWVQQKPG QLPRGLIGGTNKRAPGVPARFSGSLLGGKAALTLSGAQPEDEAE YYCALWYSNKWVFGGGTKLTVL |
| SEQ ID NO: 107 | CD3#3, #4 VL | EAVVTQEPSLTVSPGGTVTLTCRSSTGAVTTSNYANWVQQKPG QLPRGLIGGTNKRAPGVPARFSGSLLGGKAALTLSGAQPEDEAE YYCALWYSNLWVFGGGTKLTVL |
| SEQ ID NO: 108 | CD3#5 VH | EVQLVESGGGLVQPGGSLKLSCAASGFTFNTYAMNWVRQAPGK CLEWVARIRSKYNNYATYYADSVKDRFTISRDDSKNTAYLQMNN LKTEDTAVYYCVRHGNFGNSYVSWFAYWGQGTLVTVSA |
| SEQ ID NO: 109 | CD3#5 VL | EAVVTQEPSLTVSPGGTVTLTCRSSTGAVTTSNYANWVQQKPG QLPRGLIGGTNKRAPGVPARFSGSLLGGKAALTLSGAQPEDEAE YYCALWYSNLWVFGGGTKLTVL |
| SEQ ID NO: 110 | CD3#6 VH | EVQLVESGGGLVQPGGSLKLSCAASGFTFNTYAMNWVRQAPGK GLEWVARIRSKYNNYATYYADSVKGRFTISRDDSKNTAYLQMNN LKTEDTAVYYCVRHGNFGNSYVSWFAYWGQGTLVTVSA |
| SEQ ID NO: 111 | CD3#6 VL | QAVVTQEPSLTVSPGGTVTLTCRSSTGAVTTSNYANWVQQKPG QLPRGLIGGTNKRAPGVPARFSGSLLGGKAALTLSGAQPEDEAE YYCALWYSNLWVFGGGTKLTVL |
| SEQ ID NO: 112 | CD3#7 VH | EVQLVESGGGLVQPGGSLKLSCAASGFTFNTYAMNWVRQAPGK CLEWVARIRSKYNNYATYYADSVKGRFTISRDDSKNTAYLQMNN LKTEDTAVYYCVRHGNFGNSYVSWFAYWGQGTLVTVSA |
| SEQ ID NO: 113 | CD3#7 VL | QAVVTQEPSLTVSPGGTVTLTCRSSTGAVTTSNYANWVQQKPG QLPRGLIGGTNKRAPGVPARFSGSLLGGKAALTLSGAQPEDEAE YYCALWYSNLWVFGGGTKLTVL |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 114 | CD3#8 VL | QAVVTQEPSLTVSPGGTVTLTCRSSTGAVTTSNYANWVQQKPG QLPRGLIGGTNKRAPWVPARFSGSLLGGKAALTLSGAQPEDEAE YFCALWYSNLWVFGGGTKLTVL |
| SEQ ID NO: 115 | CD3#9 VL | EAVVTQEPSLTVSPGGTVTLTCRSSTGAVTTSNYANWVQQKPG QLPRGLIGGTNKRAPWVPARFSGSLLGGKAALTLSGAQPEDEAE YFCALWYSNLWVFGGGTKLTVL |
| SEQ ID NO: 116 | CD3#10 VL | EAVVTQEPSLTVSPGGTVTLTCRSSTGAVTTSNYANWVQQKPG QLPRGLIGGTNKRAPGVPARFSGSLLGGKAALTLSGAQPEDEAE YFCALWYSNLWVFGGGTKLTVL |
| SEQ ID NO: 117 | CD3#11 VL | EAVVTQEPSLTVSPGGTVTLTCRSSTGAVTTSNYANWVQQKPG QLPRGLIGGTNKRAPGVPARFSGSLLGGKAALTLSGAQPEDEAE YFCALWYSNKWVFGGGTKLTVL |
| SEQ ID NO: 118 | CD3#12 VH | EVQLVESGGGLVQPGGSLKLSCAASGFTFNTYAMNWVRQAPGK GLEWVARIRSKYNNYATYYADSVKDRFTISRDDSKNTAYLQMNN LKTEDTAVYYCVRHGNFLNSYVSWFAYWGQGTLVTVSA |
| SEQ ID NO: 119 | CD3#12 VL | EAVVTQEPSLTVSPGGTVTLTCRSSTGAVTTSYYANWVQQKPGK SPRGLIGGTNKRAPGVPARFSGSLLGGKAALTISGAQPEDEADYY CALWYSNHWVFGGGTKLTVL |
| SEQ ID NO: 120 | CD3#13 VL | EAVVTQEPSLTVSPGGTVTLTCRSSTGAVTTSNYANWVQQKPGK SPRGLIGGTNKRAPGVPARFSGSLLGGKAALTISGAQPEDEADYY CALWYSNLWVFGVGTKLTVL |
| SEQ ID NO: 121 | CD3#14 VL | EAVVTQEPSLTVSPGGTVTLTCRSSTGAVTTSNYANWVQQKPGK SPRGLIGGTNIRAPGVPARFSGSLLGGKAALTISGAQPEDEADYY CALWYSNLWVFGYGTKLTVL |
| SEQ ID NO: 122 | CD3#15 VL | EAVVTQEPSLTVSPGGTVTLTCRSSTGAVTTSNYANWVQQKPGK SPRGLIGGTNIRAPGVPARFSGSLLGGKAALTISGAQPEDEAWYF CALWYSNLWVFGGGTKLTVL |
| SEQ ID NO: 123 | CD3#16 VL | QAVVTQEPSLTVSPGGTVTLTCISSTGAVTTSNYANWVQQKPGK SPRGLIGGTNIRAPGVPARFSGSLLGGKAALTISGAQPEDEADYY CALWYSNLWVFGGGTKLTVL |
| SEQ ID NO: 124 | CD3#17, #18, #19 VH | EVQLVESGGGLVQPGGSLRLSCAASGFTFSTYAMNWVRQAPGK GLEWVGRIRSKYNNYATYYADSVKGRFTISRDDSKNTLYLQMNS LRAEDTAVYYCVRHGNFIDSYVSWFAYWGQGTLVTVSS |
| SEQ ID NO: 125 | CD3#17 VL | QAVVTQEPSLTVSPGGTVTLTCGRSTGAVTTSNYANWVQQKPG KSPRGLIGGTNKRAPGVPARFSGSLLGGKAALTISGAQPEDEADY YCALWYSNHWVFGGGTKLTVL |
| SEQ ID NO: 126 | CD3#18 VL | QAVVTQEPSLTVSPGGTVTLTCGSSTGAVTTSWYANWVQQKPG KSPRGLIGGTNIRAPGVPARFSGSLLGGKAALTISGAQPEDEADY YCALWYSNHWVFGGGTKLTVL |
| SEQ ID NO: 127 | CD3#19, #20, #22 VL | QAVVTQEPSLTVSPGGTVTLTCGSSTGAVTTSNYANWVQQKPG KSPRGLIGGTNKRAPGVPARFSGSLLGGKAALTISGAQPEDEADY YCALWYSNHWVFGGGTKLTVL |
| SEQ ID NO: 128 | CD3#20 VH | EVQLVESGGGLVQPGGSLRLSCAASGFTFSTYAMNWVRQAPGK GLEWVGRIRSIYNNYATYYADSVKGRFTISRDDSKNTLYLQMNSL RAEDTAVYYCVRHGNFGDSYVSWFAYWGQGTLVTVSS |
| SEQ ID NO: 129 | CD3#21 VL | QAVVTQEPSLTVSPGGTVTLTCGSSTGAVTTSYYANWVKQKPGK SPRGLIGGTNIRAPGVPARFSGSLLGGKAALTISGAQPEDEADYY CALWYSNHWVFGGGTKLTVL |
| SEQ ID NO: 130 | CD3#22 VH | EVQLVESGGGLVQPGGSLRLSCAASGFTFSTYAMNWVRQAPGK GLEWVGRIRSIYNNYATYYADIVKGRFTISRDDSKNTLYLQMNSL RAEDTAVYYCVRHGNFIDSYVSWFAYWGQGTLVTVSS |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 131 | CD3#23 VL | EVQLVESGGGLVQPGGSLRLSCAASGFTFSTYAMNWVRQAPGK GLEWVGRIRSKYNNYATYYADIVKGRFTISRDDSKNTLYLQMNSL RAEDTAVYYCVRHGNFIDSYVSWFAYWGQGTLVTVSS |
| SEQ ID NO: 132 | CD3#23 VL | QAVVTQEPSLTVSPGGTVTLTCGSSTGAVTTSWYANWVQQKPG KSPRGLIGGTNKRAPGVPARFSGSLLGGKAALTISGAQPEDEADY YCALWYSNHWVFGGGTKLTVL |
| SEQ ID NO: 133 | CD3#24, #25 VH | EVQLVESGGGLVQPGGSLRLSCAASGFTFNTYAMNWVRQAPGK GLEWVARIRSKYNNYATYYADSVKDRFTISRDDSKNTAYLQMNN LKTEDTAVYYCVRHGNFGNSYVSWFAYWGQGTLVTVSS |
| SEQ ID NO: 134 | CD3#24 VL | QAVVTQEPSLTVSPGGTVTLTCGSSTGAVTTSYYANWVQQKPG KSPRGLIGGTNKRAPGVPARFSGSLLGGKAALTISGAQPEDEADY YCALWYSNHWVFGGGTKLTVL |
| SEQ ID NO: 135 | CD3#25 VL | QAVVTQEPSLTVSPGGTVTLTCGSSTGAVTTSNYANWVQQKPG KSPRGLIGGTNIRAPGVPARFSGSLLGGKAALTISGAQPEDEADY YCALWYSNHWVFGGGTKLTVL |
| SEQ ID NO: 136 | CD3#26 VH | QVQLQQPGAELGKPGTSVKLSCKASGYTFTSYWMHWVKQRPG QGLEWIGNINADTGSTNYNEKFKNRATLTVDKSSSTAYMQLSTLT SEDSAVYYCTRDGYSFYYFDYWGQGTTLTVSS |
| SEQ ID NO: 137 | CD3#26 VL | DIVMSQSPSSLAVSAGEKVTMFCKSSQSLLNSRTRKNYLAWYQQ KPGQSPKLLIYWASTRKSGVPDRFTGSGSGTDFTLTISSVQAEDL AIYYCIQSFILRTFGGGTKLEIK |
| SEQ ID NO: 138 | CD3#27 VH | QVQLVQSGAEVKKPGASVKVSCKASGYTFTSYWMHWVRQAPG QGLEWMGNINADTGSTNYNEKFKNRVTMTRDTSTSTVYMELSSL RSEDTAVYYCARDGYSFYYFDYWGQGTTVTVSS |
| SEQ ID NO: 139 | CD3#27, #39 VL | DIVMTQSPDSLAVSLGERATINCKSSQSLLNSRTRKNYLAWYQQ KPGQPPKLLIYWASTRKSGVPDRFSGSGSGTDFTLTISSLQAEDV AVYYCIQSFILRTFGQGTKLEIK |
| SEQ ID NO: 140 | CD3#28 VH | QVQLVQSGAEVKKPGASVKVSCKASGYTFTSYWMHWVRQAPG QGLEWMGNINASTGSTNYNQKFKGRVTMTVDTSTSTVYMELSSL RSEDTAVYYCTRDAYSFYYFDYWGQGTTLTVSS |
| SEQ ID NO: 141 | CD3#28, #29, #30,#42 VL | DIVMTQSPDSLAVSLGERATIFCKSSQSLLNSRTRKNYLAWYQQK PGQPPKLLIYWASTRKSGVPDRFSGSGSGTDFTLTISSLQAEDVA IYYCIQSFILRTFGQGTKLEIK |
| SEQ ID NO: 142 | CD3#29 VH | QVQLVQSGAEVKKPGASVKVSCKASGYTFTSYWMHWVRQAPG QGLEWMGNINASTGSTSYAEKFKGRVTMTVDTSTSTVYMELSSL RSEDTAVYYCTRDGYSFYYFDYWGQGTTLTVSS |
| SEQ ID NO: 143 | CD3#30 VH | QVQLVQSGAEVKKPGASVKVSCKASGYTFTSYWMHWVRQAPG QGLEWMGNINASTGSTNYAQKFQGRVTMTVDTSTSTVYMELSS LRSEDTAVYYCTRDGYSFYYFDYWGQGTTLTVSS |
| SEQ ID NO: 144 | CD3#31 VH | QVQLVQSGAEVKKPGASVKVSCKASGYTFTSYWMHWVRQAPG QGLEWMGNINASTGSTNYAQKFKGRVTMTVDTSTSTVYMELSSL RSEDTAVYYCTRDGYSFYYFDYWGQGTTLTVSS |
| SEQ ID NO: 145 | CD3#31, #32 VL | DIVMTQSPDSLAVSLGERATIFCKSSQSLLNARTRKNYLAWYQQK PGQPPKLLIYWASTRKSGVPDRFSGSGSGTDFTLTISSLQAEDVA IYYCIQSFILRTFGQGTKLEIK |
| SEQ ID NO: 146 | CD3#32 VH | QVQLVQSGAEVKKPGASVKVSCKASGYTFTSYWMHWVRQAPG QGLEWMGNINASTGSTNYAQKFQGRVTMTVDTSTSTVYMELSS LRSEDTAVYYCTRDAYSFYYFDYWGQGTTLTVSS |
| SEQ ID NO: 147 | CD3#33 VH | QVQLVQSGAEVKKPGASVKVSCKASGYTFTSYWMHWVRQAPG QGLEWIGNINASTGSTSYNQKFKGRVTMTRDTSTSTVYMELSSL RSEDTAVYYCARDGYSFYYFDYWGQGTTVTVSS |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 148 | CD3#33, #35, #37, #43 VL | DIVMTQSPDSLAVSLGERATMFCKSSQSLLNSRTRKNYLAWYQQKPGQPPKLLIYWASTRKSGVPDRFSGSGSGTDFTLTISSLQAEDVAVYYCIQSFILRTFGQGTKLEIK |
| SEQ ID NO: 149 | CD3#34 VH | QVQLVQSGAEVKKPGASVKVSCKASGYTFTSYWMHWVRQAPGQGLEWIGNINASTGSTNYNQKFKGRVTMTRDTSTSTVYMELSSLRSEDTAVYYCARDGYSFYYFDYWGQGTTVTVSS |
| SEQ ID NO: 150 | CD3#34 VL | DIVMTQSPDSLAVSLGERATMFCKSSQSLLNARTRKNYLAWYQQKPGQPPKLLIYWASTRKSGVPDRFSGSGSGTDFTLTISSLQAEDVAVYYCIQSFILRTFGQGTKLEIK |
| SEQ ID NO: 151 | CD3#35 VH | QVQLVQSGAEVKKPGASVKVSCKASGYTFTSYWMHWVRQAPGQGLEWIGNINASTGSTSYNQKFQNRVTMTRDTSTSTVYMELSSLRSEDTAVYYCARDGYSFYYFDYWGQGTTVTVSS |
| SEQ ID NO: 152 | CD3#36 VH | QVQLVQSGAEVKKPGASVKVSCKASGYTFTSYWMHWVRQAPGQGLEWIGNINASTGSTNYNQKFQNRVTMTRDTSTSTVYMELSSLRSEDTAVYYCARDGYSFYYFDYWGQGTTVTVSS |
| SEQ ID NO: 153 | CD3#37 VH | QVQLVQSGAEVKKPGASVKVSCKASGYTFTSYWMHWVRQAPGQGLEWIGNINASTGSTSYAQKFKGRVTMTRDTSTSTVYMELSSLRSEDTAVYYCARDGYSFYYFDYWGQGTTVTVSS |
| SEQ ID NO: 154 | CD3#38 VH | QVQLVQSGAEVKKPGASVKVSCKASGYTFTSYWMHWVRQAPGQGLEWMGNINADTGSTKYNQKFKGRVTMTRDTSTSTVYMELSSLRSEDTAVYYCARDGYSFYYFDYWGQGTTVTVSS |
| SEQ ID NO: 155 | CD3#38 VL | DIVMTQSPDSLAVSLGERATINCRSSQSLLNSRTRKNYLAWYQQKPGQPPKLLIYWASTRKSGVPDRFSGSGSGTDFTLTISSLQAEDVAVYYCIQSFILRTFGQGTKLEIK |
| SEQ ID NO: 156 | CD3#39 VH | QVQLVQSGAEVKKPGASVKVSCKASGYTFTSYWMHWVRQAPGQGLEWMGNINADTGSTNYNQKFQGRVTMTRDTSTSTVYMELSSLRSEDTAVYYCARDAYSFYYFDYWGQGTTVTVSS |
| SEQ ID NO: 157 | CD3#40 VH | QVQLVQSGAEVKKPGASVKVSCKASGYTFTSYWMHWVRQAPGQGLEWMGNINADTGSTKYNQKFKGRVTMTVDTSTSTVYMELSSLRSEDTAVYYCTRDGYSFYYFDYWGQGTTLTVSS |
| SEQ ID NO: 158 | CD3#40 VL | DIVMTQSPDSLAVSLGERATIFCRSSQSLLNSRTRKNYLAWYQQKPGQPPKLLIYWASTRKSGVPDRFSGSGSGTDFTLTISSLQAEDVAIYYCIQSFILRTFGQGTKLEIK |
| SEQ ID NO: 159 | CD3#41 VH | QVQLVQSGAEVKKPGASVKVSCKASGYTFTSYWMHWVRQAPGQGLEWIGNINADTGSTKYNQKFKGRVTMTRDTSTSTVYMELSSLRSEDTAVYYCARDGYSFYYFDYWGQGTTVTVSS |
| SEQ ID NO: 160 | CD3#41 VL | DIVMTQSPDSLAVSLGERATMFCRSSQSLLNSRTRKNYLAWYQQKPGQPPKLLIYWASTRKSGVPDRFSGSGSGTDFTLTISSLQAEDVAVYYCIQSFILRTFGQGTKLEIK |
| SEQ ID NO: 161 | CD3#42 VH | QVQLVQSGAEVKKPGASVKVSCKASGYTFTSYWMHWVRQAPGQGLEWMGNINADTGSTNYNQKFQGRVTMTVDTSTSTVYMELSSLRSEDTAVYYCTRDAYSFYYFDYWGQGTTLTVSS |
| SEQ ID NO: 162 | CD3#43 VH | QVQLVQSGAEVKKPGASVKVSCKASGYTFTSYWMHWVRQAPGQGLEWIGNINADTGSTNYNQKFQGRVTMTRDTSTSTVYMELSSLRSEDTAVYYCARDAYSFYYFDYWGQGTTVTVSS |
| SEQ ID NO: 163 | Trop2#5 VL | DVVMTQTPLSLPVSLGDQASISCRSSQSLVHSGNIYLHWYLQKPGLSPKLLIFKVSNRFSGVPDRFSGSGSGTDFTLKISRVEAEDLGVYFCSQSTHVWTFGGGTKLEIK |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 164 | Trop2#5 VH | EVQLQQSGPDLVKPGASVKMSCKASGFIFTDYYMNWVKQSHGK SLEWIGYIYPNNGATAYNQKFKGKATLTVDKSSSTAYMELRSLTS EDSAVYYCARESDFYAMDYWGQGTSVTVSS |
| SEQ ID NO: 165 | Trop2#7 VL | DIQMTQSSSSFSVSLGDRVTITCKASEDIYNRLAWFQQKPGNAPR LLISGATSLETGVPSRFRGSRSGKDYTLSITSLQTEDVATYYCQQ YWSTWTFGGGTKLEIK |
| SEQ ID NO: 166 | Trop2#7 VH | EVQLQQSGPELVKPGASVKMSCRASGYTFTSYAMHWVKQKPG QGLEWIGYINPYNGGTKYNEKFKGRATLTSDKSSSTAYMELSSLT SEDSAVYYCAREGIYYGAWFAYWGQGTLVTVSA |
| SEQ ID NO: 167 | TNP VH | QIQLVQSGPELKKPGETVKISCKTSGYTFTNYGMNWVKQAPGKG LKWVGWINTYTGEPKYADDFKGRFAFSVETSASTAYLQINNLKNE DTATYFCARGIYDGYHWYFDVWGAGTTVTVSS |
| SEQ ID NO: 168 | TNP VL | DVVMTQTPLSLPVSLGDQASISCRSSQSLVHSIGNTYLHWYLQKP GQSPKLLIYKVSNRFSGVPDRFSGSGSGTDFTLKITRVEAEDLGV YFCSQSTHVPFTFGSGTKLEIK |
| SEQ ID NO: 169 | Trop2#1 LC | DIQMTQSPASLSASVGETVTITCRASGNIHNYLAWYQQKQGKSP QLLVYNAITLADGVPSRFSGSGSGTQYSLKINSLQPEDFGSYYCQ HFWSTPFTFGSGTKLEIKRTVAAPSVFIFPPSDEQLKSGTASVVCL LNNFYPREAKVQWKVDNALQSGNSQESVTEQDSKDSTYSLSSTL TLSKADYEKHKVYACEVTHQGLSSPVTKSFNRGEC |
| SEQ ID NO: 170 | Trop2#1 HC (knob) | EVQLQQSGPELLKPGASVKISCKASGYTFTDYTMHWVKQSHGKS LEWIGGIYPNYGDTNYNEKFKDKATLTVDESSSTAYMELRSLTSE DSAVYYCSRKTVLLRLRYFDVWGTGTTVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEPK SCDKTHTCPPCPAPEAAGGPSVFLFPPKPKDTLMISRTPEVTCVV VDVSHEDPEVKFNWYVDGVEVHNAKTKPREEQYNSTYRVVSVL TVLHQDWLNGKEYKCKVSNKALPAPIEKTISKAKGQPREPQVYTL PPSREEMTKNQVSLWCLVKGFYPSDIAVEWESNGQPENNYKTT PPVLDSDGSFFLYSKLTVDKSRWQQGNVFSCSVMHEALHNHYT QKSLSLSPG |
| SEQ ID NO: 171 | Trop2#8 LC | DIQMTQSPSSLSASLGGKVTITCKASQDINKYIAWYQHKPGKGPR LLIHYTSTLQPGIPSRFSGSGSGRDYSFSISNLEPEDIATYYCLQY DNLWTFGGGTKLEIKRTVAAPSVFIFPPSDEQLKSGTASVVCLLN NFYPREAKVQWKVDNALQSGNSQESVTEQDSKDSTYSLSSTLTL SKADYEKHKVYACEVTHQGLSSPVTKSFNRGEC |
| SEQ ID NO: 172 | Trop2#8 HC (knob) | QVQLKESGPGLVAPSQSLSITCTVSGLSLSRYSVHWVRQPPGKG LEWLGMIWGGGSTDYNSDFKPRLSISKDNSKSQVFLKMNSLQTD DTAMYYCARKGSYYTNYGAMDYWGQGTSVTVSSASTKGPSVF PLAPSSKSTSGGTAALGCLVKDYFPEPVTVSWNSGALTSGVHTF PAVLQSSGLYSLSSVVTVPSSSLGTQTYICNVNHKPSNTKVDKRV EPKSCDKTHTCPPCPAPEAAGGPSVFLFPPKPKDTLMISRTPEVT CVVVDVSHEDPEVKFNWYVDGVEVHNAKTKPREEQYNSTYRVV SVLTVLHQDWLNGKEYKCKVSNKALPAPIEKTISKAKGQPREPQV YTLPPSREEMTKNQVSLWCLVKGFYPSDIAVEWESNGQPENNY KTTPPVLDSDGSFFLYSKLTVDKSRWQQGNVFSCSVMHEALHN HYTQKSLSLSPG |
| SEQ ID NO: 173 | Trop2#9 LC | DVVMTQTPLSLPVSLGDQASISCKSSQSLVHSNGNTFLHWYLQK PGQSPKLLIYKVSNRFSGVPDRFSGSGSGTDFTLKINRVEAEDLG VYFCSQSTHVYTFGGGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| SEQ ID NO: 174 | Trop2#9 HC (knob) | EVQLQQSGPEPVKPGASVKMSCKASGYTFTDYYMNWVKQSHG KSLEWIGYIYPNNGATGYNQKFKGKATLTVDKSSSTAYMELRSLT SEDSAVYYCAREDSYYYAMDYWGQGTSVTVSSASTKGPSVFPL APSSKSTSGGTAALGCLVKDYFPEPVTVSWNSGALTSGVHTFPA VLQSSGLYSLSSVVTVPSSSLGTQTYICNVNHKPSNTKVDKRVEP KSCDKTHTCPPCPAPEAAGGPSVFLFPPKPKDTLMISRTPEVTCV WDVSHEDPEVKFNWYVDGVEVHNAKTKPREEQYNSTYRVVSV |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| | | LTVLHQDWLNGKEYKCKVSNKALPAPIEKTISKAKGQPREPQVYT LPPSREEMTKNQVSLWCLVKGFYPSDIAVEWESNGQPENNYKTT PPVLDSDGSFFLYSKLTVDKSRWQQGNVFSCSVMHEALHNHYT QKSLSLSPG |
| SEQ ID NO: 175 | Trop2#10 LC | DVVMTQTPLSLPVSLGDQASISCRSSQSLVHSNGNTYLHWYLQK PGQSPKLLIYKVSNRFSGVPDRFSGSGSGTDFTLKISRVEAEDLG VYFCSQSTHVWTFGGGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| SEQ ID NO: 176 | Trop2#10 HC (knob) | QIQLQQSGPELVKPGAPVKISCKASGYTFTNYYIHWVKQRPGQG LEWIGYIYPGNGATAYNQKFKGKATLTADNPSSTAYMQLSSLTS EDSAVYFCAREDYYYAMDYWGQGTSVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLWCLVKGFYPSDIAVEWESNGQPENNYKTTP PVLDSDGSFFLYSKLTVDKSRWQQGNVFSCSVMHEALHNHYTQ KSLSLSPG |
| SEQ ID NO: 177 | Trop2#11 LC | DIVLTQSPPSLAVSLGQRATISCRASESVDSSVNRFMHWYQQKP GQPPKLLIYRASNLESGIPARFSGSGSRTDFTLTINPVEADDVATY YCQQSNEDPYTFGGGTKLEIKRTVAAPSVFIFPPSDEQLKSGTAS VVCLLNNFYPREAKVQWKVDNALQSGNSQESVTEQDSKDSTYS LSSTLTLSKADYEKHKVYACEVTHQGLSSPVTKSFNRGEC |
| SEQ ID NO: 178 | Trop2#11 HC (knob) | DVQLQESGPGLVKPSQSLSLTCSVTGYSITSGYYWNWIRQFPGN KLEWMGYISYDGRNNYNPSLKNRISITRDTSENQFFLKLNSVTPE DTATYYCARDTTAYFDYWGQGTTLTVSSASTKGPSVFPLAPSSK STSGGTAALGCLVKDYFPEPVTVSWNSGALTSGVHTFPAVLQSS GLYSLSSVVTVPSSSLGTQTYICNVNHKPSNTKVDKRVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLH QDWLNGKEYKCKVSNKALPAPIEKTISKAKGQPREPQVYTLPPSR EEMTKNQVSLWCLVKGFYPSDIAVEWESNGQPENNYKTTPPVLD SDGSFFLYSKLTVDKSRWQQGNVFSCSVMHEALHNHYTQKSLS LSPG |
| SEQ ID NO: 179 | Trop2#12 LC | DIQMTQSPSSLSASVGDRVTITCRASESVSSSVNRFLHWYQQKP GKAPKLLIYRASNLESGVPSRFSGSGSGTDFTLTISSLQPEDFAT YYCQQSNEDPYTFGQGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| SEQ ID NO: 180 | Trop2#12 HC (knob) | QVQLQESGPGLVKPSQTLSLTCTVSGYSISSGYYWNWIRQPPGK GLEWIGYISYSGRNLYNPSLKSRVTISRDTSKNQFSLKLSSVTAA DTAVYYCARDTTAYFDYWGQGTLVTVSSASTKGPSVFPLAPSSK STSGGTAALGCLVKDYFPEPVTVSWNSGALTSGVHTFPAVLQSS GLYSLSSVVTVPSSSLGTQTYICNVNHKPSNTKVDKRVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLH QDWLNGKEYKCKVSNKALPAPIEKTISKAKGQPREPQVYTLPPSR EEMTKNQVSLWCLVKGFYPSDIAVEWESNGQPENNYKTTPPVLD SDGSFFLYSKLTVDKSRWQQGNVFSCSVMHEALHNHYTQKSLS LSPG |
| SEQ ID NO: 181 | Trop2#13 LC | DIQMTQSPSSLSASVGDRVTITCRASESVSSSVNRFLHWYQQKP GKAPKLLIYRASNLESGVPSRFSGSGSGTDFTLTISSLQPEDFAT YYCQQSNEDPYTFGQGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| SEQ ID NO: 182 | Trop2#13 HC (knob) | QVQLQESGPGLVKPSQTLKLTCTVSGYSISSGYYWNWIRQPPGK GLEWIGYISYSGRNLYNPSLKSRVTISRDTSKNQFSLKLSSVTAA DTAVYYCARDTTAYFDYWGQGTLVTVSSASTKGPSVFPLAPSSK STSGGTAALGCLVKDYFPEPVTVSWNSGALTSGVHTFPAVLQSS GLYSLSSVVTVPSSSLGTQTYICNVNHKPSNTKVDKRVEPKSCDK |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| | | THTCPPCPAPEAAGGPSVFLFPPKPKDTLMISRTPEVTCVVVDVS HEDPEVKFNWYVDGVEVHNAKTKPREEQYNSTYRVVSVLTVLH QDWLNGKEYKCKVSNKALPAPIEKTISKAKGQPREPQVYTLPPSR EEMTKNQVSLWCLVKGFYPSDIAVEWESNGQPENNYKTTPPVLD SDGSFFLYSKLTVDKSRWQQGNVFSCSVMHEALHNHYTQKSLS LSPG |
| SEQ ID NO: 183 | Trop2#14LC | DIQMTQSPSSLSASVGDRVTITCRASESVSSSVNRFLHWYQQKP GKAPKLLIYRASNLESGVPSRFSGKGSGTDFTLTISSLQPEDFAT YYCQQSNEDPYTFGQGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| SEQ ID NO: 184 | Trop2#14 HC (knob) | QVQLQESGPGLVKPSQTLKLTCTVSGYSISSGYYWNWIRQPPGK GLEWIGYISYSGRNLYNPSLKSRVTISRDTSKNQFSLKLSSVTAA DTAVYYCARDTTAYFDYWGQGTLVTVSSASTKGPSVFPLAPSSK STSGGTAALGCLVKDYFPEPVTVSWNSGALTSGVHTFPAVLQSS GLYSLSSVVTVPSSSLGTQTYICNVNHKPSNTKVDKRVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLH QDWLNGKEYKCKVSNKALPAPIEKTISKAKGQPREPQVYTLPPSR EEMTKNQVSLWCLVKGFYPSDIAVEWESNGQPENNYKTTPPVLD SDGSFFLYSKLTVDKSRWQQGNVFSCSVMHEALHNHYTQKSLS LSPG |
| SEQ ID NO: 185 | Trop2#15 LC | DIQMTQSPSSLSASVGDRVTITCRASESVSSSVNRFLHWYQQKP GKAPKLLIYRASNLESGVPSRFSGSGSGTDFTLTIRSLQPEDFAT YYCQQSNEDPYTFGQGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| SEQ ID NO: 186 | Trop2#15 HC (knob) | QVQLQESGPGLVKPSQTLKLTCTVSGYSISSGYYWNWIRQPPGK GLEWIGYISYSGRNLYNPSLKSRVTISRDTSKNQFSLKLSSVTAA DTAVYYCARDTTAYFDYWGQGTLVTVSSASTKGPSVFPLAPSSK STSGGTAALGCLVKDYFPEPVTVSWNSGALTSGVHTFPAVLQSS GLYSLSSVVTVPSSSLGTQTYICNVNHKPSNTKVDKRVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLH QDWLNGKEYKCKVSNKALPAPIEKTISKAKGQPREPQVYTLPPSR EEMTKNQVSLWCLVKGFYPSDIAVEWESNGQPENNYKTTPPVLD SDGSFFLYSKLTVDKSRWQQGNVFSCSVMHEALHNHYTQKSLS LSPG |
| SEQ ID NO: 187 | Trop2#16 LC | DIQMTQSPSSLSASVGDRVTITCRASESVSSSVNRFLHWYQQKP GKAPKLLIYRASNLESGVPSRFSGSGSGTDFTLTIRSLQPEDFAT YYCQQSNEDPYTFGQGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| SEQ ID NO: 188 | Trop2#16 HC (knob) | QVQLQESGPGLVKPSQTLSLTCTVSGYSISSGYYWNWIRQPPGK GLEWIGYISYSGRNLYNPSLKSRVTISRDTSKNQFSLKLSRVTAA DTAVYYCARDTTAYFDYWGQGTLVTVSSASTKGPSVFPLAPSSK STSGGTAALGCLVKDYFPEPVTVSWNSGALTSGVHTFPAVLQSS GLYSLSSVVTVPSSSLGTQTYICNVNHKPSNTKVDKRVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLH QDWLNGKEYKCKVSNKALPAPIEKTISKAKGQPREPQVYTLPPSR EEMTKNQVSLWCLVKGFYPSDIAVEWESNGQPENNYKTTPPVLD SDGSFFLYSKLTVDKSRWQQGNVFSCSVMHEALHNHYTQKSLS LSPG |
| SEQ ID NO: 189 | Trop2#17LC | DIRMTQSPSSLSASVGDRVTITCRASESVSSSVNRFLHWYQQKP GKAPKLLIYRASNLESGVPSRFSGSGSGTDFTLTISSLQPEDFAT YYCQQSNEDPYTFGQGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| SEQ ID NO: 190 | Trop2#17 HC (knob) | QVQLQESGPGLVKPSQTLKLTCTVSGYSISSGYYWNWIRQPPGK GLEWIGYISYSGRNLYNPSLKSRVTISRDTSKNQFSLKLSSVTAA DTAVYYCARDTTAYFDYWGQGTLVTVSSASTKGPSVFPLAPSSK |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| | | STSGGTAALGCLVKDYFPEPVTVSWNSGALTSGVHTFPAVLQSS GLYSLSSVVTVPSSSLGTQTYICNVNHKPSNTKVDKRVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLH QDWLNGKEYKCKVSNKALPAPIEKTISKAKGQPREPQVYTLPPSR EEMTKNQVSLWCLVKGFYPSDIAVEWESNGQPENNYKTTPPVLD SDGSFFLYSKLTVDKSRWQQGNVFSCSVMHEALHNHYTQKSLS LSPG |
| SEQ ID NO: 191 | Trop2#18 LC | DIQMTQSPSSLSASVGDRVTITCRASESVSSSVNRFLHWYQQKP GKAPKLLIYRASNLESGVPSRFSGKGSGTDFTLTISSLQPEDFAT YYCQQSNEDPYTFGQGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| SEQ ID NO: 192 | Trop2#18 HC (knob) | QVQLQESGPGLVKPSQTLSLTCTVSGYSISSGYYWNWIRQPPGK GLEWIGYISYSGRNLYNPSLKSRVTISRDTSKNQFSLKLSRVTAA DTAVYYCARDTTAYFDYWGQGTLVTVSSASTKGPSVFPLAPSSK STSGGTAALGCLVKDYFPEPVTVSWNSGALTSGVHTFPAVLQSS GLYSLSSVVTVPSSSLGTQTYICNVNHKPSNTKVDKRVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLH QDWLNGKEYKCKVSNKALPAPIEKTISKAKGQPREPQVYTLPPSR EEMTKNQVSLWCLVKGFYPSDIAVEWESNGQPENNYKTTPPVLD SDGSFFLYSKLTVDKSRWQQGNVFSCSVMHEALHNHYTQKSLS LSPG |
| SEQ ID NO: 193 | TNP LC | DVVMTQTPLSLPVSLGDQASISCRSSQSLVHSIGNTYLHWYLQKP GQSPKLLIYKVSNRFSGVPDRFSGSGSGTDFTLKITRVEAEDLGV YFCSQSTHVPFTFGSGTKLEIKRTVAAPSVFIFPPSDEQLKSGTAS VVCLLNNFYPREAKVQWKVDNALQSGNSQESVTEQDSKDSTYS LSSTLTLSKADYEKHKVYACEVTHQGLSSPVTKSFNRGEC |
| SEQ ID NO: 194 | TNP HC (hole) | QIQLVQSGPELKKPGETVKISCKTSGYTFTNYGMNWVKQAPGKG LKWVGWINTYTGEPKYADDFKGRFAFSVETSASTAYLQINNLKNE DTATYFCARGIYDGYHWYFDVWGAGTTVTVSS ASTKGPSVFPLAPSSKSTSGGTAALGCLVKDYFPEPVTVSWNSG ALTSGVHTFPAVLQSSGLYSLSSVVTVPSSSLGTQTYICNVNHKP SNTKVDKRVEPKSCDKTHTCPPCPAPEAAGGPSVFLFPPKPKDT LMISRTPEVTCVVVDVSHEDPEVKFNWYVDGVEVHNAKTKPREE QYNSTYRVVSVLTVLHQDWLNGKEYKCKVSNKALPAPIEKTISKA KGQPREPQVYTLPPSREEMTKNQVSLSCAVKGFYPSDIAVEWES NGQPENNYKTTPPVLDSDGSFFLVSKLTVDKSRWQQGNVFSCS VMHEALHNRFTQKSLSLSPG |
| SEQ ID NO: 195 | TNP HC (knob) | QIQLVQSGPELKKPGETVKISCKTSGYTFTNYGMNWVKQAPGKG LKWVGWINTYTGEPKYADDFKGRFAFSVETSASTAYLQINNLKNE DTATYFCARGIYDGYHWYFDVWGAGTTVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEPK SCDKTHTCPPCPAPEAAGGPSVFLFPPKPKDTLMISRTPEVTCVV VDVSHEDPEVKFNWYVDGVEVHNAKTKPREEQYNSTYRVVSVL TVLHQDWLNGKEYKCKVSNKALPAPIEKTISKAKGQPREPQVYTL PPSREEMTKNQVSLWCLVKGFYPSDIAVEWESNGQPENNYKTT PPVLDSDGSFFLYSKLTVDKSRWQQGNVFSCSVMHEALHNHYT QKSLSLSPG |
| SEQ ID NO: 196 | CDH17#1 LC | DIVMSQSPSSLAVSVGEKVTMSCKSSQSLLYSSNQKNYLAWYQ QKPGQSPKLLIYWASTRESGVPDRFTGSGSGTDFTLTISSVKAED LAVYYCQQYYSYPWTFGGGTKLEIKRTVAAPSVFIFPPSDEQLKS GTASVVCLLNNFYPREAKVQWKVDNALQSGNSQESVTEQDSKD STYSLSSTLTLSKADYEKHKVYACEVTHQGLSSPVTKSFNRGEC |
| SEQ ID NO: 197 | CDH17#1 HC (hole) | QVQLQQSDAELVKPGASVKISCKVSGYTFTDHTIHWMKQRPEQG LEWIGYIYPRDGSTKYNEKFKGKATLTADKSSSTAYMQLNSLTSE DSAVYFCARWGYYYGSSRYYFDYWGQGTTLTVSSASTKGPSVF PLAPSSKSTSGGTAALGCLVKDYFPEPVTVSWNSGALTSGVHTF PAVLQSSGLYSLSSVVTVPSSSLGTQTYICNVNHKPSNTKVDKRV EPKSCDKTHTCPPCPAPEAAGGPSVFLFPPKPKDTLMISRTPEVT CVVVDVSHEDPEVKFNWYVDGVEVHNAKTKPREEQYNSTYRVV |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| | | SVLTVLHQDWLNGKEYKCKVSNKALPAPIEKTISKAKGQPREPQV YTLPPSREEMTKNQVSLSCAVKGFYPSDIAVEWESNGQPENNYK TTPPVLDSDGSFFLVSKLTVDKSRWQQGNVFSCSVMHEALHNRF TQKSLSLSPG |
| SEQ ID NO: 198 | CDH17#8 LC | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGEC |
| SEQ ID NO: 199 | CDH17#8 HC (hole) | QVQLVQSGAEVKKPGSSVKVSCKASGYTFSDHTIHWVRQAPGQ GLEWMGYIYPRLGSTKYAEKFQGRVTITADKSTSTAYMELSSLR SEDTAVYYCARWGYYYGSSRYYFDYWGQGTLVTVSSASTKGPS VFPLAPSSKSTSGGTAALGCLVKDYFPEPVTVSWNSGALTSGVH TFPAVLQSSGLYSLSSVVTVPSSSLGTQTYICNVNHKPSNTKVDK RVEPKSCDKTHTCPPCPAPEAAGGPSVFLFPPKPKDTLMISRTPE VTCVVVDVSHEDPEVKFNWYVDGVEVHNAKTKPREEQYNSTYR VVSVLTVLHQDWLNGKEYKCKVSNKALPAPIEKTISKAKGQPREP QVYTLPPSREEMTKNQVSLSCAVKGFYPSDIAVEWESNGQPENN YKTTPPVLDSDGSFFLVSKLTVDKSRWQQGNVFSCSVMHEALHN RFTQKSLSLSPG |
| SEQ ID NO: 200 | Trop2#1 full length (knob) | DIQMTQSPASLSASVGETVTITCRASGNIHNYLAWYQQKQGKSP QLLVYNAITLADGVPSRFSGSGSGTQYSLKINSLQPEDFGSYYCQ HFWSTPFTFGSGTKLEIKRTVAAPSVFIFPPSDEQLKSGTASVVCL LNNFYPREAKVQWKVDNALQSGNSQESVTEQDSKDSTYSLSSTL TLSKADYEKHKVYACEVTHQGLSSPVTKSFNRGECGGGGSEGK SSGSGSESKSTEGKSSGSGSESKSTGGGGSEVQLQQSGPELLK PGASVKISCKASGYTFTDYTMHWVKQSHGKSLEWIGGIYPNYGD TNYNEKFKDKATLTVDESSSTAYMELRSLTSEDSAVYYCSRKTV LLRLRYFDVWGTGTTVTVSSASTKGPSVFPLAPSSKSTSGGTAA LGCLVKDYFPEPVTVSWNSGALTSGVHTFPAVLQSSGLYSLSSV VTVPSSSLGTQTYICNVNHKPSNTKVDKRVEPKSCDKTHTCPPC PAPEAAGGPSVFLFPPKPKDTLMISRTPEVTCVVVDVSHEDPEVK FNWYVDGVEVHNAKTKPREEQYNSTYRVVSVLTVLHQDWLNGK EYKCKVSNKALPAPIEKTISKAKGQPREPQVYTLPPSREEMTKNQ VSLWCLVKGFYPSDIAVEWESNGQPENNYKTTPPVLDSDGSFFL YSKLTVDKSRWQQGNVFSCSVMHEALHNHYTQKSLSLSPG |
| SEQ ID NO: 201 | Trop2#2 full length (knob) | DIQMTQSPASQSASLGDSVTITCLASQTIGTWLAWYQRKPGKSP QLLIYGATSLADGVPSRFSGNGSGTKFSFKISGLQAEDFVSYFCQ QLYSTPYTFGGGTKLEIKRTVAAPSVFIFPPSDEQLKSGTASVVCL LNNFYPREAKVQWKVDNALQSGNSQESVTEQDSKDSTYSLSSTL TLSKADYEKHKVYACEVTHQGLSSPVTKSFNRGECGGGGSEGK SSGSGSESKSTEGKSSGSGSESKSTGGGGSEVQLQQSGPELVK PGASVKISCKASGYTFTDYFMDWVKLSHEKSLEWIGDINPHNGG SDYNQKFKGKATLTVDRSSSTAYMELRSLTSEDSAVYYCAKGPY YYGGGPYWY FDVWGTGTTVTVSSASTKGPSVFPLAPSSKSTSG GTAALGCLVKDYFPEPVTVSWNSGALTSGVHTFPAVLQSSGLYS LSSVVTVPSSSLGTQTYICNVNHKPSNTKVDKRVEPKSCDKTHTC PPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALPAPIEKTISKAKGQPREPQVYTLPPSREEMT KNQVSLWCLVKGFYPSDIAVEWESNGQPENNYKTTPPVLDSDG SFFLYSKLTVDKSRWQQGNVFSCSVMHEALHNHYTQKSLSLSPG |
| SEQ ID NO: 202 | Trop2#3 full length (knob) | DILLTQSPAILSVSPGERVSFSCRASQNIGTSIHWYQQRTNGSPR LLIKYASESIYGIPSRFSGSGSGTDFTLNINSVESEDIGDYYCQQS NSWPFTFGSGTKLEIKRTVAAPSVFIFPPSDEQLKSGTASVVCLL NNFYPREAKVQWKVDNALQSGNSQESVTEQDSKDSTYSLSSTL TLSKADYEKHKVYACEVTHQGLSSPVTKSFNRGECGGGGSEGK SSGSGSESKSTEGKSSGSGSESKSTGGGGSQVQLQQPGAELVK PGASVKLSCKASGYTFTSYWINWVRQRPGQGLEWIGNIYPGNSI TNYNENFKSKATLTADKSSTAYMQLSSLTSEDSAVYYCTSSSSF DYWGQGTTLTVSSASTKGPSVFPLAPSSKSTSGGTAALGCLVKD YFPEPVTVSWNSGALTSGVHTFPAVLQSSGLYSLSSVVTVPSSSL GTQTYICNVNHKPSNTKVDKRVEPKSCDKTHTCPPCPAPEAAGG PSVFLFPPKPKDTLMISRTPEVTCVVVDVSHEDPEVKFNWYVDG VEVHNAKTKPREEQYNSTYRVVSVLTVLHQDWLNGKEYKCKVS |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| | | NKALPAPIEKTISKAKGQPREPQVYTLPPSREEMTKNQVSLWCLV KGFYPSDIAVEWESNGQPENNYKTTPPVLDSDGSFFLYSKLTVD KSRWQQGNVFSCSVMHEALHNHYTQKSLSLSPG |
| SEQ ID NO: 203 | Trop2#4 full length (knob) | DILLIQSPAILSVSPGERVSFSCRASQSIGTHIHWFQQRKNGSPRL LIDYASESISGIPSRFSGSGSGTDFILTINSVESEDIADYYCQHSHS WPFTFGSGTKLEIKRTVAAPSVFIFPPSDEQLKSGTASVVCLLNNF YPREAKVQWKVDNALQSGNSQESVTEQDSKDSTYSLSSTLTLSK ADYEKHKVYACEVTHQGLSSPVTKSFNRGECGGGGSEGKSSGS GSESKSTEGKSSGSGSESKSTGGGGSQVQLQQPGAELVKPGAS VKMSCKTSGYTFTIYWINWVKQRPGQGLEWIGNIFPGRGITNYNE KFKTKASLTLDTSSSTVYMQLSSLTFEDSAVYYCSRGSNSDYWG QGTTLTVSSASTKGPSVFPLAPSSKSTSGGTAALGCLVKDYFPEP VTVSWNSGALTSGVHTFPAVLQSSGLYSLSSVVTVPSSSLGTQT YICNVNHKPSNTKVDKRVEPKSCDKTHTCPPCPAPEAAGGPSVF LFPPKPKDTLMISRTPEVTCVVVDVSHEDPEVKFNWYVDGVEVH NAKTKPREEQYNSTYRVVSVLTVLHQDWLNGKEYKCKVSNKALP APIEKTISKAKGQPREPQVYTLPPSREEMTKNQVSLWCLVKGFYP SDIAVEWESNGQPENNYKTTPPVLDSDGSFFLYSKLTVDKSRWQ QGNVFSCSVMHEALHNHYTQKSLSLSPG |
| SEQ ID NO: 204 | Trop2#5 full length (knob) | DVVMTQTPLSLPVSLGDQASISCRSSQSLVHSHGNIYLHWYLQK PGLSPKLLIFKVSNRFSGVPDRFSGSGSGTDFTLKISRVEAEDLG VYFCSQSTHVWTFGGGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGECGGG GSEGKSSGSGSESKSTEGKSSGSGSESKSTGGGGSEVQLQQS GPDLVKPGASVKMSCKASGFIFTDYYMNWVKQSHGKSLEWIGYI YPNNGATAYNQKFKGKATLTVDKSSSTAYMELRSLTSEDSAVYY CARESDFYAMDYWGQGTSVTVSSASTKGPSVFPLAPSSKSTSG GTAALGCLVKDYFPEPVTVSWNSGALTSGVHTFPAVLQSSGLYS LSSVVTVPSSSLGTQTYICNVNHKPSNTKVDKRVEPKSCDKTHTC PPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALPAPIEKTISKAKGQPREPQVYTLPPSREEMT KNQVSLWCLVKGFYPSDIAVEWESNGQPENNYKTTPPVLDSDG SFFLYSKLTVDKSRWQQGNVFSCSVMHEALHNHYTQKSLSLSPG |
| SEQ ID NO: 205 | Trop2#6 full length (knob) | DILLTQSPAILSVSPGERVSFSCRASQSIGTSIHWFQQRTNGSPRL LIKYASESISGIPSRFSGSGSGTDFTLTINSVESEDIADYYCQQTNT WPFTFGSGTKLEIKRTVAAPSVFIFPPSDEQLKSGTASVVCLLNNF YPREAKVQWKVDNALQSGNSQESVTEQDSKDSTYSLSSTLTLSK ADYEKHKVYACEVTHQGLSSPVTKSFNRGECGGGGSEGKSSGS GSESKSTEGKSSGSGSESKSTGGGGSQVQLQQSGTELVRPGTS VKMSCKAAGYTFTNYWINWVKQRPGHGLEWIGNIYPGGGYTNY NEKFKGKASLTADTSSSTAYMQLSSLTSEDSAIYYCARGINDYW GQGTTLTVSSASTKGPSVFPLAPSSKSTSGGTAALGCLVKDYFP EPVTVSWNSGALTSGVHTFPAVLQSSGLYSLSSVVTVPSSSLGT QTYICNVNHKPSNTKVDKRVEPKSCDKTHTCPPCPAPEAAGGPS VFLFPPKPKDTLMISRTPEVTCVVVDVSHEDPEVKFNWYVDGVE VHNAKTKPREEQYNSTYRVVSVLTVLHQDWLNGKEYKCKVSNK ALPAPIEKTISKAKGQPREPQVYTLPPSREEMTKNQVSLWCLVKG FYPSDIAVEWESNGQPENNYKTTPPVLDSDGSFFLYSKLTVDKS RWQQGNVFSCSVMHEALHNHYTQKSLSLSPG |
| SEQ ID NO: 206 | Trop2#7 full length (knob) | DIQMTQSSSSFSVSLGDRVTITCKASEDIYNRLAWFQQKPGNAP RLLISGATSLETGVPSRFRGSRSGKDYTLSITSLQTEDVATYYCQ QYWSTWTFGGGTKLEIKRTVAAPSVFIFPPSDEQLKSGTASVVCL LNNFYPREAKVQWKVDNALQSGNSQESVTEQDSKDSTYSLSSTL TLSKADYEKHKVYACEVTHQGLSSPVTKSFNRGECGGGGSEGK SSGSGSESKSTEGKSSGSGSESKSTGGGGSEVQLQQSGPELVK PGASVKMSCRASGYTFTSYAMHWVKQKPGQGLEWIGYINPYNG GTKYNEKFKGRATLTSDKSSSTAYMELSSLTSEDSAVYYCAREG IYYGAWFAYWGQGTLVTVSSASTKGPSVFPLAPSSKSTSGGTAA LGCLVKDYFPEPVTVSWNSGALTSGVHTFPAVLQSSGLYSLSSV VTVPSSSLGTQTYICNVNHKPSNTKVDKRVEPKSCDKTHTCPPC PAPEAAGGPSVFLFPPKPKDTLMISRTPEVTCVVVDVSHEDPEVK FNWYVDGVEVHNAKTKPREEQYNSTYRVVSVLTVLHQDWLNGK |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| | | EYKCKVSNKALPAPIEKTISKAKGQPREPQVYTLPPSREEMTKNQ VSLWCLVKGFYPSDIAVEWESNGQPENNYKTTPPVLDSDGSFFL YSKLTVDKSRWQQGNVFSCSVMHEALHNHYTQKSLSLSPG |
| SEQ ID NO: 207 | Trop2#8 full length (knob) | DIQMTQSPSSLSASLGGKVTITCKASQDINKYIAWYQHKPGKGPR LLIHYTSTLQPGIPSRFSGSGSRDYSFSISNLEPEDIATYYCLQY DNLWTFGGGTKLEIKRTVAAPSVFIFPPSDEQLKSGTASVVCLLN NFYPREAKVQWKVDNALQSGNSQESVTEQDSKDSTYSLSSTLTL SKADYEKHKVYACEVTHQGLSSPVTKSFNRGECGGGGSEGKSS GSGSESKSTEGKSSGSGSESKSTGGGGSQVQLKESGPGLVAPS QSLSITCTVSGLSLSRYSVHWVRQPPGKGLEWLGMIWGGGSTD YNSDFKPRLSISKDNSKSQVFLKMNSLQTDDTAMYYCARKGSYY TNYGAMDYWGQGTSVTVSSASTKGPSVFPLAPSSKSTSGGTAA LGCLVKDYFPEPVTVSWNSGALTSGVHTFPAVLQSSGLYSLSSV VTVPSSSLGTQTYICNVNHKPSNTKVDKRVEPKSCDKTHTCPPC PAPEAAGGPSVFLFPPKPKDTLMISRTPEVTCVVVDVSHEDPEVK FNWYVDGVEVHNAKTKPREEQYNSTYRVVSVLTVLHQDWLNGK EYKCKVSNKALPAPIEKTISKAKGQPREPQVYTLPPSREEMTKNQ VSLWCLVKGFYPSDIAVEWESNGQPENNYKTTPPVLDSDGSFFL YSKLTVDKSRWQQGNVFSCSVMHEALHNHYTQKSLSLSPG |
| SEQ ID NO: 208 | Trop2#9 full length (knob) | DVVMTQTPLSLPVSLGDQASISCKSSQSLVHSNGNTFLHWYLQK PGQSPKLLIYKVSNRFSGVPDRFSGSGSGTDFTLKINRVEAEDLG VYFCSQSTHVYTFGGGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGECGGG GSEGKSSGSGSESKSTEGKSSGSGSESKSTGGGGSEVQLQQS GPEPVKPGASVKMSCKASGYTFTDYYMNWVKQSHGKSLEWIGY IYPNNGATGYNQKFKGKATLTVDKSSSTAYMELRSLTSEDSAVY YCAREDSYYYAMDYWGQGTSVTVSSASTKGPSVFPLAPSSKST SGGTAALGCLVKDYFPEPVTVSWNSGALTSGVHTFPAVLQSSGL YSLSSVVTVPSSSLGTQTYICNVNHKPSNTKVDKRVEPKSCDKTH TCPPCPAPEAAGGPSVFLFPPKPKDTLMISRTPEVTCVVVDVSHE DPEVKFNWYVDGVEVHNAKTKPREEQYNSTYRVVSVLTVLHQD WLNGKEYKCKVSNKALPAPIEKTISKAKGQPREPQVYTLPPSREE MTKNQVSLWCLVKGFYPSDIAVEWESNGQPENNYKTTPPVLDS DGSFFLYSKLTVDKSRWQQGNVFSCSVMHEALHNHYTQKSLSL SPG |
| SEQ ID NO: 209 | Trop2#10 full length (knob) | DVVMTQTPLSLPVSLGDQASISCRSSQSLVHSNGNTYLHWYLQK PGQSPKLLIYKVSNRFSGVPDRFSGSGSGTDFTLKISRVEAEDLG VYFCSQSTHVWTFGGGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGECGGG GSEGKSSGSGSESKSTEGKSSGSGSESKSTGGGGSQIQLQQSG PELVKPGAPVKISCKASGYTFTNYYIHWVKQRPGQGLEWIGYIYP GNGATAYNQKFKGKATLTADNPSSTAYMQLSSLTSEDSAVYFCA REDYYYAMDYWGQGTSVTVSSASTKGPSVFPLAPSSKSTSGGT AALGCLVKDYFPEPVTVSWNSGALTSGVHTFPAVLQSSGLYSLS SVVTVPSSSLGTQTYICNVNHKPSNTKVDKRVEPKSCDKTHTCP PCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALPAPIEKTISKAKGQPREPQVYTLPPSREEMTK NQVSLWCLVKGFYPSDIAVEWESNGQPENNYKTTPPVLDSDGSF FLYSKLTVDKSRWQQGNVFSCSVMHEALHNHYTQKSLSLSPG |
| SEQ ID NO: 210 | Trop2#11 full length (knob) | DIVLTQSPPSLAVSLGQRATISCRASESVDSSVNRFMHWYQQKP GQPPKLLIYRASNLESGIPARFSGSGSRTDFTLTINPVEADDVATY YCQQSNEDPYTFGGGTKLEIKRTVAAPSVFIFPPSDEQLKSGTAS VVCLLNNFYPREAKVQWKVDNALQSGNSQESVTEQDSKDSTYS LSSTLTLSKADYEKHKVYACEVTHQGLSSPVTKSFNRGECGGGG SEGKSSGSGSESKSTEGKSSGSGSESKSTGGGGSDVQLQESGP GLVKPSQSLSLTCSVTGYSITSGYYWNWIRQFPGNKLEWMGYIS YDGRNNYNPSLKNRISITRDTSENQFFLKLNSVTPEDTATYYCAR DTTAYFDYWGQGTTLTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSCDKTHTCPPCP APEAAGGPSVFLFPPKPKDTLMISRTPEVTCVVVDVSHEDPEVKF NWYVDGVEVHNAKTKPREEQYNSTYRVVSVLTVLHQDWLNGKE YKCKVSNKALPAPIEKTISKAKGQPREPQVYTLPPSREEMTKNQV |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| | | SLWCLVKGFYPSDIAVEWESNGQPENNYKTTPPVLDSDGSFFLY<br>SKLTVDKSRWQQGNVFSCSVMHEALHNHYTQKSLSLSPG |
| SEQ ID NO: 211 | Trop2#12 full length (knob) | DIQMTQSPSSLSASVGDRVTITCRASESVSSSVNRFLHWYQQKP<br>GKAPKLLIYRASNLESGVPSRFSGSGSGTDFTLTISSLQPEDFAT<br>YYCQQSNEDPYTFGQGTKLEIKRTVAAPSVFIFPPSDEQLKSGTA<br>SVVCLLNNFYPREAKVQWKVDNALQSGNSQESVTEQDSKDSTY<br>SLSSTLTLSKADYEKHKVYACEVTHQGLSSPVTKSFNRGECGGG<br>GSEGKSSGSGSESKSTEGKSSGSGSESKSTGGGGSQVQLQES<br>GPGLVKPSQTLSLTCTVSGYSISSGYYWNWIRQPPGKGLEWIGYI<br>SYSGRNLYNPSLKSRVTISRDTSKNQFSLKLSSVTAADTAVYYCA<br>RDTTAYFDYWGQGTLVTVSSASTKGPSVFPLAPSSKSTSGGTAA<br>LGCLVKDYFPEPVTVSWNSGALTSGVHTFPAVLQSSGLYSLSSV<br>VTVPSSSLGTQTYICNVNHKPSNTKVDKRVEPKSCDKTHTCPPC<br>PAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALPAPIEKTISKAKGQPREPQVYTLPPSREEMTKNQ<br>VSLWCLVKGFYPSDIAVEWESNGQPENNYKTTPPVLDSDGSFFL<br>YSKLTVDKSRWQQGNVFSCSVMHEALHNHYTQKSLSLSPG |
| SEQ ID NO: 212 | Trop2#13 full length (knob) | DIQMTQSPSSLSASVGDRVTITCRASESVSSSVNRFLHWYQQKP<br>GKAPKLLIYRASNLESGVPSRFSGSGSGTDFTLTISSLQPEDFAT<br>YYCQQSNEDPYTFGQGTKLEIKRTVAAPSVFIFPPSDEQLKSGTA<br>SVVCLLNNFYPREAKVQWKVDNALQSGNSQESVTEQDSKDSTY<br>SLSSTLTLSKADYEKHKVYACEVTHQGLSSPVTKSFNRGECGGG<br>GSEGKSSGSGSESKSTEGKSSGSGSESKSTGGGGSQVQLQES<br>GPGLVKPSQTLSLTCTVSGYSISSGYYWNWIRQPPGKGLEWIGYI<br>SYSGRNLYNPSLKSRVTISRDTSKNQFSLKLSSVTAADTAVYYCA<br>RDTTAYFDYWGQGTLVTVSSASTKGPSVFPLAPSSKSTSGGTAA<br>LGCLVKDYFPEPVTVSWNSGALTSGVHTFPAVLQSSGLYSLSSV<br>VTVPSSSLGTQTYICNVNHKPSNTKVDKRVEPKSCDKTHTCPPC<br>PAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALPAPIEKTISKAKGQPREPQVYTLPPSREEMTKNQ<br>VSLWCLVKGFYPSDIAVEWESNGQPENNYKTTPPVLDSDGSFFL<br>YSKLTVDKSRWQQGNVFSCSVMHEALHNHYTQKSLSLSPG |
| SEQ ID NO: 213 | Trop2#14 full length (knob) | DIQMTQSPSSLSASVGDRVTITCRASESVSSSVNRFLHWYQQKP<br>GKAPKLLIYRASNLESGVPSRFSGKGSGTDFTLTISSLQPEDFAT<br>YYCQQSNEDPYTFGQGTKLEIKRTVAAPSVFIFPPSDEQLKSGTA<br>SVVCLLNNFYPREAKVQWKVDNALQSGNSQESVTEQDSKDSTY<br>SLSSTLTLSKADYEKHKVYACEVTHQGLSSPVTKSFNRGECGGG<br>GSEGKSSGSGSESKSTEGKSSGSGSESKSTGGGGSQVQLQES<br>GPGLVKPSQTLKLTCTVSGYSISSGYYWNWIRQPPGKGLEWIGYI<br>SYSGRNLYNPSLKSRVTISRDTSKNQFSLKLSSVTAADTAVYYCA<br>RDTTAYFDYWGQGTLVTVSSASTKGPSVFPLAPSSKSTSGGTAA<br>LGCLVKDYFPEPVTVSWNSGALTSGVHTFPAVLQSSGLYSLSSV<br>VTVPSSSLGTQTYICNVNHKPSNTKVDKRVEPKSCDKTHTCPPC<br>PAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALPAPIEKTISKAKGQPREPQVYTLPPSREEMTKNQ<br>VSLWCLVKGFYPSDIAVEWESNGQPENNYKTTPPVLDSDGSFFL<br>YSKLTVDKSRWQQGNVFSCSVMHEALHNHYTQKSLSLSPG |
| SEQ ID NO: 214 | Trop2#15 full length (knob) | DIQMTQSPSSLSASVGDRVTITCRASESVSSSVNRFLHWYQQKP<br>GKAPKLLIYRASNLESGVPSRFSGSGSGTDFTLTIRSLQPEDFAT<br>YYCQQSNEDPYTFGQGTKLEIKRTVAAPSVFIFPPSDEQLKSGTA<br>SVVCLLNNFYPREAKVQWKVDNALQSGNSQESVTEQDSKDSTY<br>SLSSTLTLSKADYEKHKVYACEVTHQGLSSPVTKSFNRGECGGG<br>GSEGKSSGSGSESKSTEGKSSGSGSESKSTGGGGSQVQLQES<br>GPGLVKPSQTLKLTCTVSGYSISSGYYWNWIRQPPGKGLEWIGYI<br>SYSGRNLYNPSLKSRVTISRDTSKNQFSLKLSSVTAADTAVYYCA<br>RDTTAYFDYWGQGTLVTVSSASTKGPSVFPLAPSSKSTSGGTAA<br>LGCLVKDYFPEPVTVSWNSGALTSGVHTFPAVLQSSGLYSLSSV<br>VTVPSSSLGTQTYICNVNHKPSNTKVDKRVEPKSCDKTHTCPPC<br>PAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALPAPIEKTISKAKGQPREPQVYTLPPSREEMTKNQ<br>VSLWCLVKGFYPSDIAVEWESNGQPENNYKTTPPVLDSDGSFFL<br>YSKLTVDKSRWQQGNVFSCSVMHEALHNHYTQKSLSLSPG |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 215 | Trop2#16 full length (knob) | DIQMTQSPSSLSASVGDRVTITCRASESVSSSVNRFLHWYQQKP GKAPKLLIYRASNLESGVPSRFSGSGSGTDFTLTIRSLQPEDFAT YYCQQSNEDPYTFGQGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGECGGG GSEGKSSGSGSESKSTEGKSSGSGSESKSTGGGGSQVQLQES GPGLVKPSQTLSLTCTVSGYSISSGYYWNWIRQPPGKGLEWIGYI SYSGRNLYNPSLKSRVTISRDTSKNQFSLKLSRVTAADTAVYYCA RDTTAYFDYWGQGTLVTVSSASTKGPSVFPLAPSSKSTSGGTAA LGCLVKDYFPEPVTVSWNSGALTSGVHTFPAVLQSSGLYSLSSV VTVPSSSLGTQTYICNVNHKPSNTKVDKRVEPKSCDKTHTCPPC PAPEAAGGPSVFLFPPKPKDTLMISRTPEVTCVVVDVSHEDPEVK FNWYVDGVEVHNAKTKPREEQYNSTYRVVSVLTVLHQDWLNGK EYKCKVSNKALPAPIEKTISKAKGQPREPQVYTLPPSREEMTKNQ VSLWCLVKGFYPSDIAVEWESNGQPENNYKTTPPVLDSDGSFFL YSKLTVDKSRWQQGNVFSCSVMHEALHNHYTQKSLSLSPG |
| SEQ ID NO: 216 | Trop2#17 full length (knob) | DIRMTQSPSSLSASVGDRVTITCRASESVSSSVNRFLHWYQQKP GKAPKLLIYRASNLESGVPSRFSGSGSGTDFTLTISSLQPEDFAT YYCQQSNEDPYTFGQGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGECGGG GSEGKSSGSGSESKSTEGKSSGSGSESKSTGGGGSQVQLQES GPGLVKPSQTLKLTCTVSGYSISGYYWNWIRQPPGKGLEWIGYI SYSGRNLYNPSLKSRVTISRDTSKNQFSLKLSSVTAADTAVYYCA RDTTAYFDYWGQGTLVTVSSASTKGPSVFPLAPSSKSTSGGTAA LGCLVKDYFPEPVTVSWNSGALTSGVHTFPAVLQSSGLYSLSSV VTVPSSSLGTQTYICNVNHKPSNTKVDKRVEPKSCDKTHTCPPC PAPEAAGGPSVFLFPPKPKDTLMISRTPEVTCVVVDVSHEDPEVK FNWYVDGVEVHNAKTKPREEQYNSTYRVVSVLTVLHQDWLNGK EYKCKVSNKALPAPIEKTISKAKGQPREPQVYTLPPSREEMTKNQ VSLWCLVKGFYPSDIAVEWESNGQPENNYKTTPPVLDSDGSFFL YSKLTVDKSRWQQGNVFSCSVMHEALHNHYTQKSLSLSPG |
| SEQ ID NO: 217 | Trop2#18 full length (knob) | DIQMTQSPSSLSASVGDRVTITCRASESVSSSVNRFLHWYQQKP GKAPKLLIYRASNLESGVPSRFSGKGSGTDFTLTISSLQPEDFAT YYCQQSNEDPYTFGQGTKLEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGECGGG GSEGKSSGSGSESKSTEGKSSGSGSESKSTGGGGSQVQLQES GPGLVKPSQTLSLTCTVSGYSISSGYYWNWIRQPPGKGLEWIGYI SYSGRNLYNPSLKSRVTISRDTSKNQFSLKLSRVTAADTAVYYCA RDTTAYFDYWGQGTLVTVSSASTKGPSVFPLAPSSKSTSGGTAA LGCLVKDYFPEPVTVSWNSGALTSGVHTFPAVLQSSGLYSLSSV VTVPSSSLGTQTYICNVNHKPSNTKVDKRVEPKSCDKTHTCPPC PAPEAAGGPSVFLFPPKPKDTLMISRTPEVTCVVVDVSHEDPEVK FNWYVDGVEVHNAKTKPREEQYNSTYRVVSVLTVLHQDWLNGK EYKCKVSNKALPAPIEKTISKAKGQPREPQVYTLPPSREEMTKNQ VSLWCLVKGFYPSDIAVEWESNGQPENNYKTTPPVLDSDGSFFL YSKLTVDKSRWQQGNVFSCSVMHEALHNHYTQKSLSLSPG |
| SEQ ID NO: 218 | TNP full length (hole) | DVVMTQTPLSLPVSLGDQASISCRSSQSLVHSIGNTYLHWYLQKP GQSPKLLIYKVSNRFSGVPDRFSGSGSGTDFTLKITRVEAEDLGV YFCSQSTHVPFTFGSGTKLEIKRTVAAPSVFIFPPSDEQLKSGTAS VVCLLNNFYPREAKVQWKVDNALQSGNSQESVTEQDSKDSTYS LSSTLTLSKADYEKHKVYACEVTHQGLSSPVTKSFNRGECGGG SEGKSSGSGSESKSTEGKSSGSGSESKSTGGGGSQIQLVQSGP ELKKPGETVKISCKTSGYTFTNYGMNWVKQAPGKGLKWVGWIN TYTGEPKYADDFKGRFAFSVETSASTAYLQINNLKNEDTATYFCA RGIYDGYHWYFDVWGAGTTVTVSSASTKGPSVFPLAPSSKSTSG GTAALGCLVKDYFPEPVTVSWNSGALTSGVHTFPAVLQSSGLYS LSSVVTVPSSSLGTQTYICNVNHKPSNTKVDKRVEPKSCDKTHTC PPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALPAPIEKTISKAKGQPREPQVYTLPPSREEMT KNQVSLSCAVKGFYPSDIAVEWESNGQPENNYKTTPPVLDSDGS FFLVSKLTVDKSRWQQGNVFSCSVMHEALHNRFTQKSLSLSPG |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 219 | TNP full length (knob) | DVVMTQTPLSLPVSLGDQASISCRSSQSLVHSIGNTYLHWYLQKP GQSPKLLIYKVSNRFSGVPDRFSGSGSGTDFTLKITRVEAEDLGV YFCSQSTHVPFTFGSGTKLEIKRTVAAPSVFIFPPSDEQLKSGTAS VVCLLNNFYPREAKVQWKVDNALQSGNSQESVTEQDSKDSTYS LSSTLTLSKADYEKHKVYACEVTHQGLSSPVTKSFNRGECGGGG SEGKSSGSGSESKSTEGKSSGSGSESKSTGGGGSQIQLVQSGP ELKKPGETVKISCKTSGYTFTNYGMNWVKQAPGKGLKWVGWIN TYTGEPKYADDFKGRFAFSVETSASTAYLQINNLKNEDTATYFCA RGIYDGYHWYFDVWGAGTTVTVSSASTKGPSVFPLAPSSKSTSG GTAALGCLVKDYFPEPVTVSWNSGALTSGVHTFPAVLQSSGLYS LSSVVTVPSSSLGTQTYICNVNHKPSNTKVDKRVEPKSCDKTHTC PPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALPAPIEKTISKAKGQPREPQVYTLPPSREEMT KNQVSLWCLVKGFYPSDIAVEWESNGQPENNYKTTPPVLDSDG SFFLYSKLTVDKSRWQQGNVFSCSVMHEALHNHYTQKSLSLSPG |
| SEQ ID NO: 220 | CDH17#1 full length (hole) | DIVMSQSPSSLAVSVGEKVTMSCKSSQSLLYSSNQKNYLAWYQ QKPGQSPKLLIYWASTRESGVPDRFTGSGSGTDFTLTISSVKAED LAVYYCQQYYSYPWTFGGGTKLEIKRTVAAPSVFIFPPSDEQLKS GTASVVCLLNNFYPREAKVQWKVDNALQSGNSQESVTEQDSKD STYSLSSTLTLSKADYEKHKVYACEVTHQGLSSPVTKSFNRGEC GGGGSEGKSSGSGSESKSTEGKSSGSGSESKSTGGGGSQVQL QQSGAELVKPGASVKISCKVSGYTFTDHTIHWMKQRPEQGLEWI GYIYPRDGSTKYNEKFKGKATLTADKSSSTAYMQLNSLTSEDSA VYFCARWGYYYGSSRYYFDYWGQGTTLTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEPK SCDKTHTCPPCPAPEAAGGPSVFLFPPKPKDTLMISRTPEVTCVV VDVSHEDPEVKFNWYVDGVEVHNAKTKPREEQYNSTYRVVSVL TVLHQDWLNGKEYKCKVSNKALPAPIEKTISKAKGQPREPQVYTL PPSREEMTKNQVSLSCAVKGFYPSDIAVEWESNGQPENNYKTTP PVLDSDGSFFLVSKLTVDKSRWQQGNVFSCSVMHEALHNRFTQ KSLSLSPG |
| SEQ ID NO: 221 | CDH17#8 full length (hole) | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLSCAVKGFYPSDIAVEWESNGQPENNYKTTPP VLDSDGSFFLVSKLTVDKSRWQQGNVFSCSVMHEALHNRFTQK SLSLSPG |
| SEQ ID NO: 222 | CD3#1 scFv | EAVVTQEPSLTVSPGGTVTLTCRSSTGAVTTSNYANWVQEKPG QLPRGLIGGTNKRAPWVPARFSGSLLGGKAALTLSGAQPEDEAE YFCALWYSNLWVFGGGTKLTVLGGSEGKSSGSGSESKSTGGSE VQLVESGGGLVQPGGSLKLSCAASGFTFNTYAMNWVRQAPGKG LEWVARIRSKYNNYATYYADSVKDRFTISRDDSKNTAYLQMNNL KTEDTAVYYCVRHGNFGNSYVSWFAYWGQGTLVTVSA |
| SEQ ID NO: 223 | CD3#2 scFv | EAVVTQEPSLTVSPGGTVTLTCRSSTGAVTTSNYANWVQQKPG QLPRGLIGGTNKRAPGVPARFSGSLLGGKAALTLSGAQPEDEAE YYCALWYSNKWVFGGGTKLTVLGGSEGKSSGSGSESKSTGGS EVQLVESGGGLVQPGGSLKLSCAASGFTFNTYAMNWVRQAPGK GLEWVARIRSKYNNYATYYADSVKDRFTISRDDSKNTAYLQMNN LKTEDTAVYYCVRHGNFGNSYVSWFAYWGQGTLVTVSA |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 224 | CD3#3 scFv | EAVVTQEPSLTVSPGGTVTLTCRSSTGAVTTSNYANWVQQKPG QLPRGLIGGTNKRAPWVPARFSGSLLGGKAALTLSGAQPEDEAE YYCALWYSNLWVFGGGTKLTVLGGSEGKSSGSGSESKSTGGSE VQLVESGGGLVQPGGSLKLSCAASGFTFNTYAMNWVRQAPGKG LEWVARIRSKYNNYATYYADSVKDRFTISRDDSKNTAYLQMNNL KTEDTAVYYCVRHGNFGNSYVSWFAYWGQGTLVTVSA |
| SEQ ID NO: 225 | CD3#4 scFv | EAVVTQEPSLTVSPGGTVTLTCRSSTGAVTTSNYANWVQQKPG QLPRGLIGGTNKRAPGVPARFSGSLLGGKAALTLSGAQPEDEAE YYCALWYSNLWVFGGGTKLTVLGGSEGKSSGSGSESKSTGGSE VQLVESGGGLVQPGGSLKLSCAASGFTFNTYAMNWVRQAPGKG LEWVARIRSKYNNYATYYADSVKDRFTISRDDSKNTAYLQMNNL KTEDTAVYYCVRHGNFGNSYVSWFAYWGQGTLVTVSA |
| SEQ ID NO: 226 | CD3#5 scFv | EAVVTQEPSLTVSPGGTVTLTCRSSTGAVTTSNYANWVQQKPG QLPRGLIGGTNKRAPGVPARFSGSLLGGKAALTLSGAQPEDEAE YYCALWYSNLWVFGCGTKLTVLGGSEGKSSGSGSESKSTGGSE VQLVESGGGLVQPGGSLKLSCAASGFTFNTYAMNWVRQAPGKC LEWVARIRSKYNNYATYYADSVKDRFTISRDDSKNTAYLQMNNL KTEDTAVYYCVRHGNFGNSYVSWFAYWGQGTLVTVSA |
| SEQ ID NO: 227 | CD3#6 scFv | QAVVTQEPSLTVSPGGTVTLTCRSSTGAVTTSNYANWVQQKPG QLPRGLIGGTNKRAPGVPARFSGSLLGGKAALTLSGAQPEDEAE YYCALWYSNLWVFGGGTKLTVLGGSEGKSSGSGSESKSTGGSE VQLVESGGGLVQPGGSLKLSCAASGFTFNTYAMNWVRQAPGKG LEWVARIRSKYNNYATYYADSVKGRFTISRDDSKNTAYLQMNNL KTEDTAVYYCVRHGNFGNSYVSWFAYWGQGTLVTVSA |
| SEQ ID NO: 228 | CD3#7 scFv | QAVVTQEPSLTVSPGGTVTLTCRSSTGAVTTSNYANWVQQKPG QLPRGLIGGTNKRAPGVPARFSGSLLGGKAALTLSGAQPEDEAE YYCALWYSNLWVFGCGTKLTVLGGSEGKSSGSGSESKSTGGSE VQLVESGGGLVQPGGSLKLSCAASGFTFNTYAMNWVRQAPGKC LEWVARIRSKYNNYATYYADSVKGRFTISRDDSKNTAYLQMNNL KTEDTAVYYCVRHGNFGNSYVSWFAYWGQGTLVTVSA |
| SEQ ID NO: 229 | CD3#8 scFv | QAVVTQEPSLTVSPGGTVTLTCRSSTGAVTTSNYANWVQQKPG QLPRGLIGGTNKRAPWVPARFSGSLLGGKAALTLSGAQPEDEAE YFCALWYSNLWVFGGGTKLTVLGGSEGKSSGSGSESKSTGGSE VQLVESGGGLVQPGGSLKLSCAASGFTFNTYAMNWVRQAPGKG LEWVARIRSKYNNYATYYADSVKDRFTISRDDSKNTAYLQMNNL KTEDTAVYYCVRHGNFGNSYVSWFAYWGQGTLVTVSA |
| SEQ ID NO: 230 | CD3#9 scFv | EAVVTQEPSLTVSPGGTVTLTCRSSTGAVTTSNYANWVQQKPG QLPRGLIGGTNKRAPWVPARFSGSLLGGKAALTLSGAQPEDEAE YFCALWYSNLWVFGGGTKLTVLGGSEGKSSGSGSESKSTGGSE VQLVESGGGLVQPGGSLKLSCAASGFTFNTYAMNWVRQAPGKG LEWVARIRSKYNNYATYYADSVKDRFTISRDDSKNTAYLQMNNL KTEDTAVYYCVRHGNFGNSYVSWFAYWGQGTLVTVSA |
| SEQ ID NO: 231 | CD3#10scFv | EAVVTQEPSLTVSPGGTVTLTCRSSTGAVTTSNYANWVQQKPG QLPRGLIGGTNKRAPGVPARFSGSLLGGKAALTLSGAQPEDEAE YFCALWYSNLWVFGGGTKLTVLGGSEGKSSGSGSESKSTGGSE VQLVESGGGLVQPGGSLKLSCAASGFTFNTYAMNWVRQAPGKG LEWVARIRSKYNNYATYYADSVKDRFTISRDDSKNTAYLQMNNL KTEDTAVYYCVRHGNFGNSYVSWFAYWGQGTLVTVSA |
| SEQ ID NO: 232 | CD3#11 scFv | EAVVTQEPSLTVSPGGTVTLTCRSSTGAVTTSNYANWVQQKPG QLPRGLIGGTNKRAPGVPARFSGSLLGGKAALTLSGAQPEDEAE YFCALWYSNLWVFGGGTKLTVLGGSEGKSSGSGSESKSTGGS EVQLVESGGGLVQPGGSLKLSCAASGFTFNTYAMNWVRQAPG GLEWVARIRSKYNNYATYYADSVKDRFTISRDDSKNTAYLQMNN LKTEDTAVYYCVRHGNFGNSYVSWFAYWGQGTLVTVSA |
| SEQ ID NO: 233 | CD3#12scFv | EAVVTQEPSLTVSPGGTVTLTCRSSTGAVTTSNYANWVQQKPG KSPRGLIGGTNKRAPGVPARFSGSLLGGKAALTISGAQPEDAD YYCALWYSNLWVFGGGTKLTVLGGSEGKSSGSGSESKSTGGS EVQLVESGGGLVQPGGSLKLSCAASGFTFNTYAMNWVRQAPGK GLEWVARIRSKYNNYATYYADSVKDRFTISRDDSKNTAYLQMNN LKTEDTAVYYCVRHGNFLNSYVSWFAYWGQGTLVTVSA |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 234 | CD3#13scFv | EAVVTQEPSLTVSPGGTVTLTCRSSTGAVTTSNYANWVQQKPG KSPRGLIGGTNKRAPGVPARFSGSLLGGKAALTISGAQPEDEAD YYCALWYSNLWVFGVGTKLTVLGGSEGKSSGSGSESKSTGGSE VQLVESGGGLVQPGGSLKLSCAASGFTFNTYAMNWVRQAPGKG LEWVARIRSKYNNYATYYADSVKDRFTISRDDSKNTAYLQMNNL KTEDTAVYYCVRHGNFGNSYVSWFAYWGQGTLVTVSA |
| SEQ ID NO: 235 | CD3#14 scFv | EAVVTQEPSLTVSPGGTVTLTCRSSTGAVTTSNYANWVQQKPG KSPRGLIGGTNIRAPGVPARFSGSLLGGKAALTISGAQPEDEADY YCALWYSNLWVFGYGTKLTVLGGSEGKSSGSGSESKSTGGSEV QLVESGGGLVQPGGSLKLSCAASGFTFNTYAMNWVRQAPGKGL EWVARIRSKYNNYATYYADSVKDRFTISRDDSKNTAYLQMNNLK TEDTAVYYCVRHGNFGNSYVSWFAYWGQGTLVTVSA |
| SEQ ID NO: 236 | CD3#15 scFv | EAVVTQEPSLTVSPGGTVTLTCRSSTGAVTTSNYANWVQQKPG KSPRGLIGGTNIRAPGVPARFSGSLLGGKAALTISGAQPEDEAWY FCALWYSNLWVFGGGTKLTVLGGSEGKSSGSGSESKSTGGSEV QLVESGGGLVQPGGSLKLSCAASGFTFNTYAMNWVRQAPGKGL EWVARIRSKYNNYATYYADSVKDRFTISRDDSKNTAYLQMNNLK TEDTAVYYCVRHGNFLNSYVSWFAYWGQGTLVTVSA |
| SEQ ID NO: 237 | CD3#16scFv | QAVVTQEPSLTVSPGGTVTLTCISSTGAVTTSNYANWVQQKPGK SPRGLIGGTNIRAPGVPARFSGSLLGGKAALTISGAQPEDEADYY CALWYSNLWVFGGGTKLTVLGGSEGKSSGSGSESKSTGGSEV QLVESGGGLVQPGGSLKLSCAASGFTFNTYAMNWVRQAPGKGL EWVARIRSKYNNYATYYADSVKDRFTISRDDSKNTAYLQMNNLK TEDTAVYYCVRHGNFGNSYVSWFAYWGQGTLVTVSA |
| SEQ ID NO: 238 | CD3#17 scFv | QAVVTQEPSLTVSPGGTVTLTCGRSTGAVTTSNYANWVQQKPG KSPRGLIGGTNKRAPGVPARFSGSLLGGKAALTISGAQPEDEAD YYCALWYSNLWVFGGGTKLTVLGGSEGKSSGSGSESKSTGGSE EVQLVESGGGLVQPGGSLRLSCAASGFTFSTYAMNWVRQAPGK GLEWVGRIRSKYNNYATYYADSVKGRFTISRDDSKNTLYLQMNS LRAEDTAVYYCVRHGNFIDSYVSWFAYWGQGTLVTVSS |
| SEQ ID NO: 239 | CD3#18scFv | QAVVTQEPSLTVSPGGTVTLTCGSSTGAVTTSWYANWVQQKPG KSPRGLIGGTNIRAPGVPARFSGSLLGGKAALTISGAQPEDEADY YCALWYSNHWVFGGGTKLTVLGGSEGKSSGSGSESKSTGGSE VQLVESGGGLVQPGGSLRLSCAASGFTFSTYAMNWVRQAPGKG LEWVGRIRSKYNNYATYYADSVKGRFTISRDDSKNTLYLQMNSL RAEDTAVYYCVRHGNFIDSYVSWFAYWGQGTLVTVSS |
| SEQ ID NO: 240 | CD3#19scFv | QAVVTQEPSLTVSPGGTVTLTCGSSTGAVTTSNYANWVQQKPG KSPRGLIGGTNKRAPGVPARFSGSLLGGKAALTISGAQPEDEAD YYCALWYSNHWVFGGGTKLTVLGGSEGKSSGSGSESKSTGGS EVQLVESGGGLVQPGGSLRLSCAASGFTFSTYAMNWVRQAPGK GLEWVGRIRSKYNNYATYYADSVKGRFTISRDDSKNTLYLQMNS LRAEDTAVYYCVRHGNFIDSYVSWFAYWGQGTLVTVSS |
| SEQ ID NO: 241 | CD3#20 scFv | QAVVTQEPSLTVSPGGTVTLTCVSSTGAVTTSNYANWVQQKPG KSPRGLIGGTNKRAPGVPARFSGSLLGGKAALTISGAQPEDEAD YYCALWYSNHWVFGGGTKLTVLGGSEGKSSGSGSESKSTGGS EVQLVESGGGLVQPGGSLRLSCAASGFTFSTYAMNWVRQAPGK GLEWVGRIRSIYNNYATYYADSVKGRFTISRDDSKNTLYLQMNSL RAEDTAVYYCVRHGNFGDSYVSWFAYWGQGTLVTVSS |
| SEQ ID NO: 242 | CD3#21 scFv | QAVVTQEPSLTVSPGGTVTLTCGSSTGAVTTSYYANWVKQKPG KSPRGLIGGTNIRAPGVPARFSGSLLGGKAALTISGAQPEDEADY YCALWYSNHWVFGGGTKLTVLGGSEGKSSGSGSESKSTGGSE VQLVESGGGLVQPGGSLKLSCAASGFTFNTYAMNWVRQAPGKG LEWVARIRSKYNNYATYYADSVKDRFTISRDDSKNTAYLQMNNL KTEDTAVYYCVRHGNFGNSYVSWFAYWGQGTLVTVSA |
| SEQ ID NO: 243 | CD3#22 scFv | QAVVTQEPSLTVSPGGTVTLTCGSSTGAVTTSNYANWVQQKPG KSPRGLIGGTNKRAPGVPARFSGSLLGGKAALTISGAQPEDEAD YYCALWYSNHWVFGGGTKLTVLGGSEGKSSGSGSESKSTGGS EVQLVESGGGLVQPGGSLRLSCAASGFTFSTYAMNWVRQAPGK GLEWVGRIRSIYNNYATYYADIVKGRFTISRDDSKNTLYLQMNSL RAEDTAVYYCVRHGNFIDSYVSWFAYWGQGTLVTVSS |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 244 | CD3#23 scFv | QAVVTQEPSLTVSPGGTVTLTCGSSTGAVTTSWYANWVQQKPG KSPRGLIGGTNKRAPGVPARFSGSLLGGKAALTISGAQPEDEAD YYCALWYSNHWVFGGGTKLTVLGGSEGKSSGSGSESKSTGGS EVQLVESGGGLVQPGGSLRLSCAASGFTFSTYAMNWVRQAPGK GLEWVGRIRSKYNNYATYYADIVKGRFTISRDDSKNTLYLQMNSL RAEDTAVYYCVRHGNFIDSYVSWFAYWGQGTLVTVSS |
| SEQ ID NO: 245 | CD3#24 scFv | QAVVTQEPSLTVSPGGTVTLTCGSSTGAVTTSYYANWVQQKPG KSPRGLIGGTNKRAPGVPARFSGSLLGGKAALTISGAQPEDEAD YYCALWYSNHWVFGGGTKLTVLGGSEGKSSGSGSESKSTGGS EVQLVESGGGLVQPGGSLRLSCAASGFTFNTYAMNWVRQAPGK GLEWVARIRSKYNNYATYYADSVKDRFTISRDDSKNTAYLQMNN LKTEDTAVYYCVRHGNFGNSYVSWFAYWGQGTLVTVSS |
| SEQ ID NO: 246 | CD3#25 scFv | QAVVTQEPSLTVSPGGTVTLTCGSSTGAVTTSNYANWVQQKPG KSPRGLIGGTNIRAPGVPARFSGSLLGGKAALTISGAQPEDEADY YCALWYSNHWVFGGGTKLTVLGGSEGKSSGSGSESKSTGGSE VQLVESGGGLVQPGGSLRLSCAASGFTFNTYAMNWVRQAPGK GLEWVARIRSKYNNYATYYADSVKDRFTISRDDSKNTAYLQMNN LKTEDTAVYYCVRHGNFGNSYVSWFAYWGQGTLVTVSS |
| SEQ ID NO: 247 | CD3#26 scFv | DIVMSQSPSSLAVSAGEKVTMFCKSSQSLLNSRTRKNYLAWYQ QKPGQSPKLLIYWASTRKSGVPDRFTGSGSGTDFTLTISSVQAE DLAIYYCIQSFILRTFGGGTKLEIKGGSEGKSSGSGSESKSTGGS QVQLQQPGAELGKPGTSVKLSCKASGYTFTSYWMHWVKQRPG QGLEWIGNINADTGSTNYNEKFKNRATLTVDKSSTAYMQLSTLT SEDSAVYYCTRDGYSFYYFDYWGQGTTLTVSS |
| SEQ ID NO: 248 | CD3#27 scFv | DIVMTQSPDSLAVSLGERATINCKSSQSLLNSRTRKNYLAWYQQ KPGQPPKLLIYWASTRKSGVPDRFSGSGSGTDFTLTISSLQAEDV AVYYCIQSFILRTFGQGTKLEIKGGSEGKSSGSGSESKSTGGSQV QLVQSGAEVKKPGASVKVSCKASGYTFTSYWMHWVRQAPGQG LEWMGNINADTGSTNYNEKFKNRVTMTRDTSTSTVYMELSSLRS EDTAVYYCARDGYSFYYFDYWGQGTTVTVSS |
| SEQ ID NO: 249 | CD3#28 scFv | DIVMTQSPDSLAVSLGERATIFCKSSQSLLNSRTRKNYLAWYQQ KPGQPPKLLIYWASTRKSGVPDRFSGSGSGTDFTLTISSLQAEDV AIYYCIQSFILRTFGQGTKLEIKGGSEGKSSGSGSESKSTGGSQV QLVQSGAEVKKPGASVKVSCKASGYTFTSYWMHWVRQAPGQG LEWMGNINASTGSTNYNQKFKGRVTMTVDTSTSTVYMELSSLRS EDTAVYYCTRDAYSFYYFDYWGQGTTLTVSS |
| SEQ ID NO: 250 | CD3#29 scFv | DIVMTQSPDSLAVSLGERATIFCKSSQSLLNSRTRKNYLAWYQQ KPGQPPKLLIYWASTRKSGVPDRFSGSGSGTDFTLTISSLQAEDV AIYYCIQSFILRTFGQGTKLEIKGGSEGKSSGSGSESKSTGGSQV QLVQSGAEVKKPGASVKVSCKASGYTFTSYWMHWVRQAPGQG LEWMGNINASTGSTSYAEKFKGRVTMTVDTSTSTVYMELSSLRS EDTAVYYCTRDGYSFYYFDYWGQGTTLTVSS |
| SEQ ID NO: 251 | CD3#30 scFv | DIVMTQSPDSLAVSLGERATIFCKSSQSLLNSRTRKNYLAWYQQ KPGQPPKLLIYWASTRKSGVPDRFSGSGSGTDFTLTISSLQAEDV AIYYCIQSFILRTFGQGTKLEIKGGSEGKSSGSGSESKSTGGSQV QLVQSGAEVKKPGASVKVSCKASGYTFTSYWMHWVRQAPGQG LEWMGNINASTGSTNYAQKFQGRVTMTVDTSTSTVYMELSSLR SEDTAVYYCTRDGYSFYYFDYWGQGTTLTVSS |
| SEQ ID NO: 252 | CD3#31 scFv | DIVMTQSPDSLAVSLGERATIFCKSSQSLLNARTRKNYLAWYQQ KPGQPPKLLIYWASTRKSGVPDRFSGSGSGTDFTLTISSLQAEDV AIYYCIQSFILRTFGQGTKLEIKGGSEGKSSGSGSESKSTGGSQV QLVQSGAEVKKPGASVKVSCKASGYTFTSYWMHWVRQAPGQG LEWMGNINASTGSTNYAQKFKGRVTMTVDTSTSTVYMELSSLRS EDTAVYYCTRDGYSFYYFDYWGQGTTLTVSS |
| SEQ ID NO: 253 | CD3#32 scFv | DIVMTQSPDSLAVSLGERATIFCKSSQSLLNARTRKNYLAWYQQ KPGQPPKLLIYWASTRKSGVPDRFSGSGSGTDFTLTISSLQAEDV AIYYCIQSFILRTFGQGTKLEIKGGSEGKSSGSGSESKSTGGSQV QLVQSGAEVKKPGASVKVSCKASGYTFTSYWMHWVRQAPGQG LEWMGNINASTGSTNYAQKFQGRVTMTVDTSTSTVYMELSSLR SEDTAVYYCTRDAYSFYYFDYWGQGTTLTVSS |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 254 | CD3#33 scFv | DIVMTQSPDSLAVSLGERATMFCKSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINASTGSTSYNQKFKGRVTMTRDTSTSTVYMELSSLRSEDTAVYYCARDGYSFYYFDYWGQGTTVTVSS |
| SEQ ID NO: 255 | CD3#34 scFv | DIVMTQSPDSLAVSLGERATMFCKSSQSLLNARTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINASTGSTNYNQKFKGRVTMTRDTSTSTVYMELSSLRSEDTAVYYCARDGYSFYYFDYWGQGTTVTVSS |
| SEQ ID NO: 256 | CD3#35 scFv | DIVMTQSPDSLAVSLGERATMFCKSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINASTGSTSYNQKFQNRVTMTRDTSTSTVYMELSSLRSEDTAVYYCARDGYSFYYFDYWGQGTTVTVSS |
| SEQ ID NO: 257 | CD3#36 scFv | DIVMTQSPDSLAVSLGERATMFCKSSQSLLNARTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINASTGSTNYNQKFQNRVTMTRDTSTSTVYMELSSLRSEDTAVYYCARDGYSFYYFDYWGQGTTVTVSS |
| SEQ ID NO: 258 | CD3#37 scFv | DIVMTQSPDSLAVSLGERATMFCKSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINASTGSTSYAQKFKGRVTMTRDTSTSTVYMELSSLRSEDTAVYYCARDGYSFYYFDYWGQGTTVTVSS |
| SEQ ID NO: 259 | CD3#38 scFv | DIVMTQSPDSLAVSLGERATINCRSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWMGNINADTGSTKYNQKFKGRVTMTRDTSTSTVYMELSSLRSEDTAVYYCARDGYSFYYFDYWGQGTTVTVSS |
| SEQ ID NO: 260 | CD3#39 scFv | DIVMTQSPDSLAVSLGERATINCKSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWMGNINADTGSTNYNQKFQGRVTMTRDTSTSTVYMELSSLRSEDTAVYYCARDAYSFYYFDYWGQGTTVTVSS |
| SEQ ID NO: 261 | CD3#40 scFv | DIVMTQSPDSLAVSLGERATIFCRSSQSLLNSRTRKNYLAWYQQKPGQPPKLLIYWASTRKSGVPDRFSGSGSGTDFTLTISSLQAEDVAIYYCIQSFILRTFGQGTKLEIKGGSEGKSSGSGSESKSTGGSQVQLVQSGAEVKKPGASVKVSCKASGYTFTSYWMHWVRQAPGQGLEWMGNINADTGSTKYNQKFKGRVTMTVDTSTSTVYMELSSLRSEDTAVYYCTRDGYSFYYFDYWGQGTTLTVSS |
| SEQ ID NO: 262 | CD3#41 scFv | DIVMTQSPDSLAVSLGERATMFCRSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINADTGSTKYNQKFKGRVTMTRDTSTSTVYMELSSLRSEDTAVYYCARDGYSFYYFDYWGQGTTVTVSS |
| SEQ ID NO: 263 | CD3#42 scFv | DIVMTQSPDSLAVSLGERATIFCKSSQSLLNSRTRKNYLAWYQQKPGQPPKLLIYWASTRKSGVPDRFSGSGSGTDFTLTISSLQAEDVAIYYCIQSFILRTFGQGTKLEIKGGSEGKSSGSGSESKSTGGSQVQLVQSGAEVKKPGASVKVSCKASGYTFTSYWMHWVRQAPGQGLEWMGNINADTGSTNYNQKFQGRVTMTVDTSTSTVYMELSSLRSEDTAVYYCTRDAYSFYYFDYWGQGTTLTVSS |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 264 | CD3#43 scFv | DIVMTQSPDSLAVSLGERATMFCKSSQSLLNSRTRKNYLAWYQ QKPGQPPKLLIYWASTRKSGVPDRFSGSGSGTDFTLTISSSLQAE DVAVYYCIQSFILRTFGQGTKLEIKGGSEGKSSGSGSESKSTGGS QVQLVQSGAEVKKPGASVKVSCKASGYTFTSYWMHWVRQAPG QGLEWIGNINADTGSTNYNQKFQGRVTMTRDTSTSTVYMELSSL RSEDTAVYYCARDAYSFYYFDYWGQGTTVTVSS |
| SEQ ID NO: 265 | Linker, e.g. between VH and VL within CD3 scFv | GGSEGKSSGSGSESKSTGGS |
| SEQ ID NO: 266 | Linker, e.g. Between LC and HC | GGGGSEGKSSGSGSESKSTEGKSSGSGSESKSTGGGGS |
| SEQ ID NO: 267 | CDH17#1(hole)/ CD3#1 full length | DIVMSQSPSSLAVSVGEKVTMSCKSSQSLLYSSNQKNYLAWYQ QKPGQSPKLLIYWASTRESGVPDRFTGSGSGTDFTLTISSVKAED LAVYYCQQYYSYPWTFGGGTKLEIKRTVAAPSVFIFPPSDEQLKS GTASVVCLLNNFYPREAKVQWKVDNALQSGNSQESVTEQDSKD STYSLSSTLTLSKADYEKHKVYACEVTHQGLSSPVTKSFNRGEC GGGGSEGKSSGSGSESKSTEGKSSGSGSESKSTGGGGSQVQL QQSDAELVKPGASVKISCKVSGYTFTDHTIHWMKQRPEQGLEWI GYIYPRDGSTKYNEKFKGKATLTADKSSSTAYMQLNSLTSEDSA VYFCARWGYYYGSSRYYFDYWGQGTTLTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEPK SCDKTHTCPPCPAPEAAGGPSVFLFPPKPKDTLMISRTPEVTCVV VDVSHEDPEVKFNWYVDGVEVHNAKTKPREEQYNSTYRVVSVL TVLHQDWLNGKEYKCKVSNKALPAPIEKTISKAKGQPREPQVYTL PPSREEMTKNQVSLSCAVKGFYPSDIAVEWESNGQPENNYKTTP PVLDSDGSFFLVSKLTVDKSRWQQGNVFSCSVMHEALHNRFTQ KSLSLSPGGGGSGGGGSGGGGSGGGGSEAVVTQEPSLTVSP GGTVTLTCRSSTGAVTTSNYANWVQEKPGQLPRGLIGGTNKRA PWVPARFSGSLLGGKAALTLSGAQPEDEAEYFCALWYSNLWVF GGGTKLTVLGGSEGKSSGSGSESKSTGGSEVQLVESGGGLVQP GGSLKLSCAASGFTFNTYAMNWVRQAPGKGLEWVARIRSKYNN YATYYADSVKDRFTISRDDSKNTAYLQMNNLKTEDTAVYYCVRH GNFGNSYVSWFAYWGQGTLVTVSA |
| SEQ ID NO: 268 | CDH17#1 (hole) / CD3#2 full length | DIVMSQSPSSLAVSVGEKVTMSCKSSQSLLYSSNQKNYLAWYQ QKPGQSPKLLIYWASTRESGVPDRFTGSGSGTDFTLTISSVKAED LAVYYCQQYYSYPWTFGGGTKLEIKRTVAAPSVFIFPPSDEQLKS GTASVVCLLNNFYPREAKVQWKVDNALQSGNSQESVTEQDSKD STYSLSSTLTLSKADYEKHKVYACEVTHQGLSSPVTKSFNRGEC GGGGSEGKSSGSGSESKSTEGKSSGSGSESKSTGGGGSQVQL QQSDAELVKPGASVKISCKVSGYTFTDHTIHWMKQRPEQGLEWI GYIYPRDGSTKYNEKFKGKATLTADKSSSTAYMQLNSLTSEDSA VYFCARWGYYYGSSRYYFDYWGQGTTLTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEPK SCDKTHTCPPCPAPEAAGGPSVFLFPPKPKDTLMISRTPEVTCVV VDVSHEDPEVKFNWYVDGVEVHNAKTKPREEQYNSTYRVVSVL TVLHQDWLNGKEYKCKVSNKALPAPIEKTISKAKGQPREPQVYTL PPSREEMTKNQVSLSCAVKGFYPSDIAVEWESNGQPENNYKTTP PVLDSDGSFFLVSKLTVDKSRWQQGNVFSCSVMHEALHNRFTQ KSLSLSPGGGGSGGGGSGGGGSGGGGSEAVVTQEPSLTVSP GGTVTLTCRSSTGAVTTSNYANWVQEKPGQLPRGLIGGTNKRA PWVPARFSGSLLGGKAALTLSGAQPEDEAEYFCALWYSNLWVF GGGTKLTVLGGSEGKSSGSGSESKSTGGSEVQLVESGGGLVQP GGSLKLSCAASGFTFNTYAMNWVRQAPGKGLEWVARIRSKYNN YATYYADSVKDRFTISRDDSKNTAYLQMNNLKTEDTAVYYCVRH GNFGNSYVSWFAYWGQGTLVTVSA |
| SEQ ID NO: 269 | CDH17#1 (hole) / CD3#3 full length | DIVMSQSPSSLAVSVGEKVTMSCKSSQSLLYSSNQKNYLAWYQ QKPGQSPKLLIYWASTRESGVPDRFTGSGSGTDFTLTISSVKAED LAVYYCQQYYSYPWTFGGGTKLEIKRTVAAPSVFIFPPSDEQLKS GTASVVCLLNNFYPREAKVQWKVDNALQSGNSQESVTEQDSKD STYSLSSTLTLSKADYEKHKVYACEVTHQGLSSPVTKSFNRGEC |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| | | GGGGSEGKSSGSGSESKSTEGKSSGSGSESKSTGGGGSQVQL QQSDAELVKPGASVKISCKVSGYTFTDHTIHWMKQRPEQGLEWI GYIIYPRDGSTKYNEKFKGKATLTADKSSSTAYMQLNSLTSEDSA VYFCARWGYYYGSSRYYFDYWGQGTTLTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEPK SCDKTHTCPPCPAPEAAGGPSVFLFPPKPKDTLMISRTPEVTCVV VDVSHEDPEVKFNWYVDGVEVHNAKTKPREEQYNSTYRVVSVL TVLHQDWLNGKEYKCKVSNKALPAPIEKTISKAKGQPREPQVYTL PPSREEMTKNQVSLSCAVKGFYPSDIAVEWESNGQPENNYKTTP PVLDSDGSFFLVSKLTVDKSRWQQGNVFSCSVMHEALHNRFTQ KSLSLSPGGGGSGGGGSGGGGSGGGGSEAVVTQEPSLTVSP GGTVTLTCRSSTGAVTTSNYANWVQEKPGQLPRGLIGGTNKRA PWVPARFSGSLLGGKAALTLSGAQPEDEAEYFCALWYSNLWVF GGGTKLTVLGGSEGKSSGSGSESKSTGGSEVQLVESGGGLVQP GGSLKLSCAASGFTFNTYAMNWVRQAPGKGLEWVARIRSKYNN YATYYADSVKDRFTISRDDSKNTAYLQMNNLKTEDTAVYYCVRH GNFGNSYVSWFAYWGQGTLVTVSA |
| SEQ ID NO: 270 | CDH17#8 (hole) / CD3#1 full length | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLSCAVKGFYPSDIAVEWESNGQPENNYKTTPP VLDSDGSFFLVSKLTVDKSRWQQGNVFSCSVMHEALHNRFTQK SLSLSPGGGGSGGGGSGGGGSGGGGSEAVVTQEPSLTVSPG GTVTLTCRSSTGAVTTSNYANWVQQKPGQLPRGLIGGTNKRAP WVPARFSGSLLGGKAALTLSGAQPEDEAEYYCALWYSNLWVFG GGTKLTVLGGSEGKSSGSGSESKSTGGSEVQLVESGGGLVQPG GSLKLSCAASGFTFNTYAMNWVRQAPGKGLEWVARIRSKYNNY ATYYADSVKDRFTISRDDSKNTAYLQMNNLKTEDTAVYYCVRHG NFGNSYVSWFAYWGQGTLVTVSA |
| SEQ ID NO: 271 | CDH17#8 (hole) / CD3#2 full length | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLSCAVKGFYPSDIAVEWESNGQPENNYKTTPP VLDSDGSFFLVSKLTVDKSRWQQGNVFSCSVMHEALHNRFTQK SLSLSPGGGGSGGGGSGGGGSGGGGSEAVVTQEPSLTVSPG GTVTLTCRSSTGAVTTSNYANWVQQKPGQLPRGLIGGTNKRAP GVPARFSGSLLGGKAALTLSGAQPEDEAEYYCALWYSNKWVFG GGTKLTVLGGSEGKSSGSGSESKSTGGSEVQLVESGGGLVQPG GSLKLSCAASGFTFNTYAMNWVRQAPGKGLEWVARIRSKYNNY ATYYADSVKDRFTISRDDSKNTAYLQMNNLKTEDTAVYYCVRHG NFGNSYVSWFAYWGQGTLVTVSA |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 272 | CDH17#8 (hole) / CD3#3 full length | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLSCAVKGFYPSDIAVEWESNGQPENNYKTTPP VLDSDGSFFLVSKLTVDKSRWQQGNVFSCSVMHEALHNRFTQK SLSLSPGGGGSGGGGSGGGGSGGGGSEAVVTQEPSLTVSPG GTVTLTCRSSTGAVTTSNYANWVQQKPGQLPRGLIGGTNKRAP WVPARFSGSLLGGKAALTLSGAQPEDEAEYYCALWYSNLWVFG GGTKLTVLGGSEGKSSGSGSESKSTGGSEVQLVESGGGLVQPG GSLKLSCAASGFTFNTYAMNWVRQAPGKGLEWVARIRSKYNNY ATYYADSVKDRFTISRDDSKNTAYLQMNNLKTEDTAVYYCVRHG NFGNSYVSWFAYWGQGTLVTVSA |
| SEQ ID NO: 273 | 4aa linker | GGGS |
| SEQ ID NO: 274 | 6aa linker | GGSGGS |
| SEQ ID NO: 275 | 20aa linker; e.g. between Fc and CD3 scFv | GGGGSGGGGSGGGGSGGGGS |
| SEQ ID NO: 276 | Trop2#1 HCDR1 (CCG) | GYTFTDYTMH |
| SEQ ID NO: 277 | Trop2#8 HCDR1 (CCG) | GLSLSRYSVH |
| SEQ ID NO: 278 | Trop2#11 HCDR1 (CCG) | GYSITSGYYWN |
| SEQ ID NO: 279 | Trop2#12 to #18 HCDR1 (COG) | GYSISSGYYWN |
| SEQ ID NO: 280 | Trop2#9 HCDR1 (COG) | GYTFTDYYMN |
| SEQ ID NO: 281 | Trop2#10 HCDR1 (CCG) | GYTFTNYYIH |
| SEQ ID NO: 282 | CDH17#1 HCDR1 (CCG) | GYTFTDHTIH |
| SEQ ID NO: 283 | CDH17#8 HCDR1 (CCG) | GYTFSDHTIH |
| SEQ ID NO: 284 | CD3#1 to #15, #20, #23, #24 HCDR1 (CCG) | GFTFNTYAMN |
| SEQ ID NO: 285 | CD3#16to #19, #21, #22 HCDR1 (CCG) | GFTFSTYAMN |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 286 | CDH17#25 to #42 HCDR1 (CCG) | GYTFTSYWMH |
| SEQ ID NO: 287 | Trop2#1 and #9 HCDR1 (Chothia) | GYTFTDY |
| SEQ ID NO: 288 | Trop2#1 HCDR2 (Chothia) | YPNYGD |
| SEQ ID NO: 289 | Trop2#8 HCDR1 (Chothia) | GLSLSRY |
| SEQ ID NO: 290 | Trop2#8 HCDR2 (Chothia) | WGGGS |
| SEQ ID NO: 291 | Trop2#11 HCDR1 (Chothia) | GYSITSGY |
| SEQ ID NO: 292 | Trop2#11 HCDR2 (Chothia) | SYDGR |
| SEQ ID NO: 293 | Trop2#12 to #18 HCDR1 (Chothia) | GYSISSGY |
| SEQ ID NO: 294 | Trop2#12 to #18 HCDR2 (Chothia) | SYSGR |
| SEQ ID NO: 295 | Trop2#9 HCDR2 (Chothia) | YPNNGA |
| SEQ ID NO: 296 | Trop2#10 HCDR1 (Chothia) | GYTFTNY |
| SEQ ID NO: 297 | Trop2#10 HCDR2 (Chothia) | YPGNGA |
| SEQ ID NO: 298 | CDH17#1 HCDR1 (Chothia) | GYTFTDH |
| SEQ ID NO: 299 | CDH17#1 HCDR2 (Chothia) | YPRDGS |
| SEQ ID NO: 300 | CDH17#8 HCDR1 (Chothia) | GYTFSDH |
| SEQ ID NO: 301 | CDH17#8 HCDR2 (Chothia) | YPRLGS |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 302 | CD3#1 to #15, #20, #23, #24 HCDR1 (Chothia) | GFTFNTY |
| SEQ ID NO: 303 | CD3#1 to #18, #20, #22, #23, #24 HCDR1 (Chothia) | RSKYNNYA |
| SEQ ID NO: 304 | CD3#16to #19, #21, #22 HCDR1 (Chothia) | GFTFSTY |
| SEQ ID NO: 305 | CD3#19, #21, HCDR1 (Chothia) | RSIYNNYA |
| SEQ ID NO: 306 | CD3#25 to #42 HCDR1 (Chothia) | GYTFTSY |
| SEQ ID NO: 307 | CD3#25, #26, #37 to #42 HCDR1 (Chothia) | NADTGS |
| SEQ ID NO: 308 | CD3#27 to #36 HCDR1 (Chothia) | NASTGS |
| SEQ ID NO: 309 | Trop2#1 HCDR1 (IMGT) | GYTFTDYT |
| SEQ ID NO: 310 | Trop2#1 HCDR2 (IMGT) | IYPNYGDT |
| SEQ ID NO: 311 | Trop2#1 HCDR3 (IMGT) | SRKTVLLRLRYFDV |
| SEQ ID NO: 312 | Trop2#1 LCDR1 (IMGT) | GNIHNY |
| w/o | Trop2#1 LCDR2 (IMGT) | NAI |
| SEQ ID NO: 314 | Trop2#8 HCDR1 (IMGT) | GLSLSRYS |
| SEQ ID NO: 315 | Trop2#8 HCDR2 (IMGT) | IWGGGST |
| SEQ ID NO: 316 | Trop2#8 HCDR3 (IMGT) | ARKGSYYTNYGAMDY |
| SEQ ID NO: 317 | Trop2#8 LCDR1 (IMGT) | QDINKY |
| w/o | Trop2#8 LCDR2 (IMGT) | YTS |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 319 | Trop2#11 HCDR1 (IMGT) | GYSITSGYY |
| SEQ ID NO: 320 | Trop2#11 HCDR2 (IMGT) | ISYDGRN |
| SEQ ID NO: 321 | Trop2#11 to #18 HCDR3 (IMGT) | ARDTTAYFDY |
| SEQ ID NO: 322 w/o | Trop2#11 LCDR1 (IMGT) Trop2#11 to #18 LCDR2 (IMGT) | ESVDSSVNRF RAS |
| SEQ ID NO: 324 | Trop2#12 to #18 HCDR1 (IMGT) | GYSISSGYY |
| SEQ ID NO: 325 | Trop2#12 to #18 HCDR2 (IMGT) | ISYSGRN |
| SEQ ID NO: 326 | Trop2#12 to #18 LCDR1 (IMGT) | ESVSSSVNRF |
| SEQ ID NO: 327 | Trop2#9 HCDR1 (IMGT) | GYTFTDYY |
| SEQ ID NO: 328 | Trop2#9 HCDR2 (IMGT) | IYPNNGAT |
| SEQ ID NO: 329 | Trop2#9 HCDR3 (IMGT) | AREDSYYYAMDY |
| SEQ ID NO: 330 w/o | Trop2#9 LCDR1 (IMGT) Trop2#9 and #10 LCDR2 (IMGT) | QSLVHSNGNTF KVS |
| SEQ ID NO: 332 | Trop2#10 HCDR1 (IMGT) | GYTFTNYY |
| SEQ ID NO: 333 | Trop2#10 HCDR2 (IMGT) | IYPGNGAT |
| SEQ ID NO: 334 | Trop2#10 HCDR3 (IMGT) | AREDYYYAMDY |
| SEQ ID NO: 335 | Trop2#10 LCDR1 (IMGT) | QSLVHSNGNTY |
| SEQ ID NO: 336 | CDH17#1 HCDR1 (IMGT) | GYTFTDHT |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 337 | CDH17#1 HCDR2 (IMGT) | IYPRDGST |
| SEQ ID NO: 338 | CDH17#1 and #8 HCDR3 (IMGT) | ARWGYYYGSSRYYFDY |
| SEQ ID NO: 339 w/o | CDH17#1 LCDR1 (IMGT) CDH17#1 and CD3#25 to #42 LCDR2 (IMGT) | QSLLYSSNQKNY WAS |
| SEQ ID NO: 341 | CDH17#8 HCDR1 (IMGT) | GYTFSDHT |
| SEQ ID NO: 342 | CDH17#8 HCDR2 (IMGT) | IYPRLGST |
| SEQ ID NO: 343 w/o | CDH17#8 LCDR1 (IMGT) CDH17#8 LCDR2 (IMGT) | QSVLYSSNQKQY GAS |
| SEQ ID NO: 345 | CD3#1 to #15, #20, #23, #24 HCDR1 (IMGT) | GFTFNTYA |
| SEQ ID NO: 346 | CD3#1 to #18, #20, #22, #23, #24 HCDR2 (IMGT) | IRSKYNNYAT |
| SEQ ID NO: 347 | CD3#1 to #10, #12, #13, #15, #20, #23, #24 HCDR3 (IMGT) | VRHGNFGNSYVSWFAY |
| SEQ ID NO: 348 w/o | CD3#1 to #10, #12 to #16, #18, #19, #21, #24 LCDR1 (IMGT) CD3#1 to #24 LCDR2 (IMGT) | TGAVTTSNY GTN |
| SEQ ID NO: 350 | CD3#11, #14 HCDR3 (IMGT) | VRHGNFLNSYVSWFAY |
| SEQ ID NO: 351 | CD3#11, #20, #23 LCDR1 (IMGT) | TGAVTTSYY |
| SEQ ID NO: 352 | CD3#16to#19, #21, #22 HCDR1 (IMGT) | GFTFSTYA |
| SEQ ID NO: 353 | CD3#16to#18, #21, #22, HCDR2 (IMGT) | VRHGNFIDSYVSWFAY |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 354 | CD3#17 and #22 LCDR1 (IMGT) | TGAVTTSWY |
| SEQ ID NO: 355 | CD3#19 and #21 HCDR2 (IMGT) | IRSIYNNYAT |
| SEQ ID NO: 356 | CD3#19 HCDR3 (IMGT) | VRHGNFGDSYVSWFAY |
| SEQ ID NO: 357 | CD3#25 to #42 HCDR1 (IMGT) | GYTFTSYW |
| SEQ ID NO: 358 | CD3#25, #26, #37 to #42 HCDR2 (IMGT) | INADTGST |
| SEQ ID NO: 359 | CD3#25, #28 to #30, #39 HCDR3 (IMGT) | TRDGYSFYYFDY |
| SEQ ID NO: 360 | CD3#25 to #29, #32, #34, #36 to #42 LCDR1 (IMGT) | QSLLNSRTRKNY |
| SEQ ID NO: 361 | CD3#26, #32 to #37, #40 HCDR3 (IMGT) | ARDGYSFYYFDY |
| SEQ ID NO: 362 | CD3#27 to #36 HCDR2 (IMGT) | INASTGST |
| SEQ ID NO: 363 | CD3#27, #31, #41 HCDR3 (IMGT) | TRDAYSFYYFDY |
| SEQ ID NO: 364 | CD3#30, #31, #33,#35 LCDR1 (IMGT) | QSLLNARTRKNY |
| SEQ ID NO: 365 | CD3#38, #42 HCDR3 (IMGT) | ARDAYSFYYFDY |
| SEQ ID NO: 366 | Trop2#1 HCDR1 (North) | KASGYTFTDYTMH |
| SEQ ID NO: 367 | Trop2#1 HCDR2 (North) | GIYPNYGDTN |
| SEQ ID NO: 368 | Trop2#1 HCDR3 (North) | SRKTVLLRLRYFDV |
| SEQ ID NO: 369 | Trop2#1 LCDR2 (North) | YNAITLAD |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 370 | Trop2#8 HCDR1 (North) | TVSGLSLSRYSVH |
| SEQ ID NO: 371 | Trop2#8 HCDR2 (North) | MIWGGGSTD |
| SEQ ID NO: 372 | Trop2#8 HCDR3 (North) | ARKGSYYTNYGAMDY |
| SEQ ID NO: 373 | Trop2#8 LCDR2 (North) | HYTSTLQP |
| SEQ ID NO: 374 | Trop2#11 HCDR1 (North) | SVTGYSITSGYYWN |
| SEQ ID NO: 375 | Trop2#11 HCDR2 (North) | YISYDGRNN |
| SEQ ID NO: 376 | Trop2#11 to #18 HCDR3 (North) | ARDTTAYFDY |
| SEQ ID NO: 377 | Trop2#11 to #18 LCDR2 (North) | YRASNLES |
| SEQ ID NO: 378 | Trop2#12 to #18 HCDR1 (North) | TVSGYSISSGYYWN |
| SEQ ID NO: 379 | Trop2#12 to #18 HCDR2 (North) | YISYSGRNL |
| SEQ ID NO: 380 | Trop2#9 HCDR1 (North) | KASGYTFTDYYMN |
| SEQ ID NO: 381 | Trop2#9 HCDR2 (North) | YIYPNNGATG |
| SEQ ID NO: 382 | Trop2#9 HCDR3 (North) | AREDSYYYAMDY |
| SEQ ID NO: 383 | Trop2#9 and #10 LCDR2 (North) | YKVSNRFS |
| SEQ ID NO: 384 | Trop2#10 HCDR1 (North) | KASGYTFTNYYIH |
| SEQ ID NO: 385 | Trop2#10 HCDR2 (North) | YIYPGNGATA |
| SEQ ID NO: 386 | Trop2#10 HCDR3 (North) | AREDYYYAMDY |
| SEQ ID NO: 387 | CDH17#1 HCDR1 (North) | KVSGYTFTDHTIH |
| SEQ ID NO: 388 | CDH17#1 HCDR2 (North) | YIYPRDGSTK |
| SEQ ID NO: 389 | CDH17#1 and #8 HCDR3 (North) | ARWGYYYGSSRYYFDY |
| SEQ ID NO: 390 | CDH17#1 LCDR2 (North) | YWASTRES |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 391 | CDH17#8 HCDR1 (North) | KASGYTFSDHTIH |
| SEQ ID NO: 392 | CDH17#8 HCDR2 (North) | YIYPRLGSTK |
| SEQ ID NO: 393 | CDH17#8 LCDR2 (North) | YGASTRET |
| SEQ ID NO: 394 | CD3#1 to #15, #20, #23, #24 HCDR1 (North) | AASGFTFNTYAMN |
| SEQ ID NO: 395 | CD3#1 to #18, #20, #22, #23, #24 HCDR2 (North) | RIRSKYNNYATY |
| SEQ ID NO: 396 | CD3#1 to #10, #12, #13, #15, #20, #23, #24 HCDR3 (North) | VRHGNFGNSYVSWFAY |
| SEQ ID NO: 397 | CD3#1 to #12, #16, #18, #19, #21, #22, #23 LCDR2 (North) | GGTNKRAP |
| SEQ ID NO: 398 | CD3#11 and #14 HCDR3 (North) | VRHGNFLNSYVSWFAY |
| SEQ ID NO: 399 | CD3#13to #15, #17, #20, #24 LCDR2 (North) | GGTNIRAP |
| SEQ ID NO: 400 | CD3#16to #18, #21, #22 HCDR1 (North) | AASGFTFSTYAMN |
| SEQ ID NO: 401 | CD3#16to #18, #21, #22 HCDR3 (North) | VRHGNFIDSYVSWFAY |
| SEQ ID NO: 402 | CD3#19 and #21 HCDR2 (North) | RIRSIYNNYATY |
| SEQ ID NO: 403 | CD3#19 HCDR3 (North) | VRHGNFGDSYVSWFAY |
| SEQ ID NO: 404 | CD3#25 to #42 HCDR1 (North) | KASGYTFTSYWMH |
| SEQ ID NO: 405 | CD3#25, #26, #38, #41, #42 HCDR2 (North) | NINADTGSTN |
| SEQ ID NO: 406 | CD3#25, #28 to #30, #39 HCDR3(North) | TRDGYSFYYFDY |
| SEQ ID NO: 407 | CD3#25 to #42 LCDR2 (North) | YWASTRKS |
| SEQ ID NO: 408 | CD3#26, #32 to #37, #40 HCDR3(North) | ARDGYSFYYFDY |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 409 | CD3#27, #29 to #31, #33, #35 HCDR2 (North) | NINASTGSTN |
| SEQ ID NO: 410 | CD3#27, #31, #41 HCDR3 (North) | TRDAYSFYYFDY |
| SEQ ID NO: 411 | CD3#28, 32, #34, #36 HCDR2 (North) | NINASTGSTS |
| SEQ ID NO: 412 | CD3#37, #39, #40 HCDR2 (North) | NINADTGSTK |
| SEQ ID NO: 413 | CD3#38 #42 HCDR3 (North) | ARDAYSFYYFDY |
| SEQ ID NO: 414 | IgG1 wildtype HC | ASTKGPSVFPLAPSSKSTSGGTAALGCLVKDYFPEPVTVSWNSG ALTSGVHTFPAVLQSSGLYSLSSVVTVPSSSLGTQTYICNVNHKP SNTKVDKRVEPKSCDKTHTCPPCPAPELLGGPSVFLFPPKPKDTL MISRTPEVTCVVVDVSHEDPEVKFNWYVDGVEVHNAKTKPREEQ YNSTYRVVSVLTVLHQDWLNGKEYKCKVSNKALPAPIEKTISKAK GQPREPQVYTLPPSRDELTKNQVSLTCLVKGFYPSDIAVEWESN GQPENNYKTTPPVLDSDGSFFLYSKLTVDKSRWQQGNVFSCSV MHEALHNHYTQKSLSLSPGK |
| SEQ ID NO: 415 | IgG1 KO HC | ASTKGPSVFPLAPSSKSTSGGTAALGCLVKDYFPEPVTVSWNSG ALTSGVHTFPAVLQSSGLYSLSSVVTVPSSSLGTQTYICNVNHKP SNTKVDKRVEPKSCDKTHTCPPCPAPEAAGGPSVFLFPPKPKDT LMISRTPEVTCVVVDVSHEDPEVKFNWYVDGVEVHNAKTKPREE QYNSTYRVVSVLTVLHQDWLNGKEYKCKVSNKALPAPIEKTISKA KGQPREPQVYTLPPSREEMTKNQVSLTCLVKGFYPSDIAVEWES NGQPENNYKTTPPVLDSDGSFFLYSKLTVDKSRWQQGNVFSCS VMHEALHNHYTQKSLSLSPG |
| SEQ ID NO: 416 | IgG4 Pro wild type HC | ASTKGPSVFPLAPCSRSTSESTAALGCLVKDYFPEPVTVSWNSG ALTSGVHTFPAVLQSSGLYSLSSVVTVPSSSLGTKTYTCNVDHKP SNTKVDKRVESKYGPPCPPCPAPEFLGGPSVFLFPPKPKDTLMIS RTPEVTCVVVDVSQEDPEVQFNWYVDGVEVHNAKTKPREEQFN STYRVVSVLTVLHQDWLNGKEYKCKVSNKGLPSSIEKTISKAKGQ PREPQVYTLPPSQEEMTKNQVSLTCLVKGFYPSDIAVEWESNGQ PENNYKTTPPVLDSDGSFFLYSRLTVDKSRWQEGNVFSCSVMH EALHNHYTQKSLSLSLGK |
| SEQ ID NO: 417 | IgG1 FeRnmut | ASTKGPSVFPLAPSSKSTSGGTAALGCLVKDYFPEPVTVSWNSG ALTSGVHTFPAVLQSSGLYSLSSVVTVPSSSLGTQTYICNVNHKP SNTKVDKRVEPKSCDKTHTCPPCPAPEAAGGPSVFLFPPKPKDT LMISRTPEVTCVVVDVSHEDPEVKFNWYVDGVEVHNAKTKPREE QYNSTYRVVSVLTVLAQDWLNGKEYKCKVSNKALPAPIEKTISKA KGQPREPQVYTLPPSREEMTKNQVSLTCLVKGFYPSDIAVEWES NGQPENNYKTTPPVLDSDGSFFLYSKLTVDKSRWQQGNVFSCS VMHEALHNHYTQKSLSLSPG |
| SEQ ID NO: 418 | human light chain constant domain (kappa) | RTVAAPSVFIFPPSDEQLKSGTASVVCLLNNFYPREAKVQWKVD NALQSGNSQESVTEQDSKDSTYSLSSTLTLSKADYEKHKVYACE VTHQGLSSPVTKSFNRGEC |
| SEQ ID NO: 419 | human Trop2 | MARGPGLAPPPLRLPLLLLLVLAAVTGHTAAQDNCTCPTNKMTVC SPDGPGGRCQCRALGSGMAVDCSTLTSKCLLLKARMSAPKNAR TLVRPSEHALVDNDGLYDPDCDPEGRFKARQCNQTSVCWCVNS VGVRRTDKGDLSLRCDELVRTHHILIDLRHRPTAGAFNHSDLDAE LRRLFRERYRLHPKFVAAVHYEQPTIQIELRQNTSQKAAGDVDIG DAAYYFERDIKGESLFQGRGGLDLRVRGEPLQVERTLIYYLDEIPP KFSMKRLTAGLIAVIVVVVALVAGMAVLVITNRRKSGKYKKVEIK ELGELRKEPSL |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| SEQ ID NO: 420 | human CDH17 | MILQAHLHSLCLLMLYLATGYGQEGKFSGPLKPMTFSIYEGQEPS QIIFQFKANPPAVTFELTGETDNIFVIEREGLLYYNRALDRETRSTH NLQVAALDANGIIVEGPVPITIKVKDINDNRPTFLQSKYEGSVRQN SRPGKPFLYVNATDLDDPATPNGQLYYQIVIQLPMINNVMYFQIN NKTGAISLTREGSQELNPAKNPSYNLVISVKDMGGQSENSFSDTT SVDIIVTENIWKAPKPVEMVENSTDPHPIKITQVRWNDPGAQYSLV DKEKLPRPPFSIDQEGDIYVTQPLDREEKDAYVFYAVAKDEYGKP LSYPLEIHVKVKDINDNPPTCPSPVTVFEVQENERLGNSIGTLTAH DRDEENTANSFLNYRIVEQTPKLPMDGLFLIQTYAGMLQLAKQSL KKQDTPQYNLTIEVSDKDFKTLCFVQINVIDINDQIPIFEKSDYGNL TLAEDTNIGSTILTIQATDADEPFTGSSKILYHIIKGDSEGRLGVDTD PHTNTGYVIIKKPLDFETAAVSNIVFKAENPEPLVFGVKYNASSFA KFTLIVTDVNEAPQFSQHVFQAKVSEDVAIGTKVGNVTAKDPEGL DISYSLRGDTRGWLKIDHVTGEIFSVAPLDREAGSPYRVQVVATE VGGSSLSSVSEFHLILMDVNDNPPRLAKDYTGLFFCHPLSAPGSL IFEATDDDQHLFRGPHFTFSLGSGSLQNDWEVSKINGTHARLSTR HTEFEEREYVVLIRINDGGRPPLEGIVSLPVTFCSCVEGSCFRPA GHQTGIPTVGMAVGILLTTLLVIGIILAVVFIRIKKDKGKDNVESAQA SEVKPLRS |
| SEQ ID NO: 421 | human CD3 delta chain | MEHSTFLSGLVLATLLSQVSPFKIPIEELEDRVFVNCNTSITWVEG TVGTLLSDITRLDLGKRILDPRGIYRCNGTDIYKDKESTVQVHYRM CQSCVELDPATVAGIIVTDVIATLLLALGVFCFAGHETGRLSGAAD TQALLRNDQVYQPLRDRDDAQYSHLGGNWARNK |
| SEQ ID NO: 422 | human CD3 epsilon chain | MQSGTHWRVLGLCLLSVGVWGQDGNEEMGGITQTPYKVSISGT TVILTCPQYPGSEILWQHNDKNIGGDEDDKNIGSDEDHLSLKEFS ELEQSGYYVCYPRGSKPEDANFYLYLRARVCENCMEMDVMSVA TIVIVDICITGGLLLLVYYWSKNRKAKAKPVTRGAGAGGRQRGQN KERPPPVPNPDYEPIRKGQRDLYSGLNQRRI |
| SEQ ID NO: 423 | human CD3 gamma chain | MEQGKGLAVLILAIILLQGTLAQSIKGNHLVKVYDYQEDGSVLLTC DAEAKNITWFKDGKMIGFLTEDKKKWNLGSNAKDPRGMYQCKG SQNKSKPLQVYYRMCQNCIELNAATISGFLFAEIVSIFVLAVGVYFI AGQDGVRQSRASDKQTLLPNDQLYQPLKDREDDQYSHLQGNQL RRN |
| SEQ ID NO: 424 | human CD3 zeta chain | MKWKALFTAAILQAQLPITEAQSFGLLDPKLCYLLDGILFIYGVILTA LFLRVKFSRSADAPAYQQGQNQLYNELNLGRREEYDVLDKRRG RDPEMGGKPQRRKNPQEGLYNELQKDKMAEAYSEIGMKGERR RGKGHDGLYQGLSTATKDTYDALHMQALPPR |
| SEQ ID NO: 424 | CDH17#8 (hole) / CD3#4 full length | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLSCAVKGFYPSDIAVEWESNGQPENNYKTTPP VLDSDGSFFLVSKLTVDKSRWQQGNVFSCSVMHEALHNRFTQK SLSLSPGGGGSGGGGSGGGGSGGGGSEAVVTQEPSLTVSPG GTVTLTCRSSTGAVTTSNYANWVQQKPGQLPRGLIGGTNKRAP GVPARFSGSLLGGKAALTLSGAQPEDEAEYYCALWYSNLWVFG CGTKLTVLGGSEGKSSGSGSESKSTGGSEVQLVESGGGLVQPG GSLKLSCAASGFTFNTYAMNWVRQAPGKCLEWVARIRSKYNNY ATYYADSVKDRFTISRDDSKNTAYLQMNNLKTEDTAVYYCVRHG NFGNSYVSWFAYWGQGTLVTVSA |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| SEQ ID NO: 425 | CDH17#8 (hole) / CD3#5 full length | EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVLVQSGAEVKKPGSSVKVSCKASGYTFSDHTIHWVRQAPGQGLEWMGYIIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGGGGSGGGGSGGGGSGGGGSQAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKGRFTISRDDSKNTAYLQMNNLKTEDTAVYYCVRHGNFGNSYVSWFAYWGQGTLVTVSA |
| SEQ ID NO: 426 | CDH17#8 (hole) / CD3#6 full length | EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGSEGKSSGSGSESKSTEGKSSGSGSESKSTGGGGSQVLVQSGAEVKKPGSSVKVSCKASGYTFSDHTIHWVRQAPGQGLEWMGYIIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGGGGSGGGGSGGGGSGGGGSQAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGCGTKLTVLGGSEGKSSGSGSESKSTGGSEVQLVESGGGLVQPGGSLKLSCAASGFTFNTYAMNWVRQAPGKCLEWVARIRSKYNNYATYYADSVKGRFTISRDDSKNTAYLQMNNLKTEDTAVYYCVRHGNFGNSYVSWFAYWGQGTLVTVSA |
| SEQ ID NO: 427 | CDH17#8 (hole) / CD3#7 full length | EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGSEGKSSGSGSESKSTEGKSSGSGSESKSTGGGGSQVLVQSGAEVKKPGSSVKVSCKASGYTFSDHTIHWVRQAPGQGLEWMGYIIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGGGGSGGGGSGGGGSGGGGSQAVVTQEPSLTVSPGGTVTLTCRSSTGAVTTSNYANWVQQKPGQLPRGLIGGTNKRAPWVPARFSGSLLGGKAALTLSGAQPEDEAEYFCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNY |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
| --- | --- | --- |
| | | ATYYADSVKDRFTISRDDSKNTAYLQMNNLKTEDTAVYYCVRHG NFGNSYVSWFAYWGQGTLVTVSA |
| SEQ ID NO: 428 | CDH17#8 (knob) / CD3#2 full length | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLWCLVKGFYPSDIAVEWESNGQPENNYKTTP PVLDSDGSFFLYSKLTVDKSRWQQGNVFSCSVMHEALHNHYTQ KSLSLSPGGGGSGGGGSGGGGSGGGGSEAVVTQEPSLTVSP GGTVTLTCRSSTGAVTTSNYANWVQQKPGQLPRGLIGGTNKRA PGVPARFSGSLLGGKAALTLSGAQPEDEAEYYCALWYSNKWVF GGGTKLTVLGGSEGKSSGSGSESKSTGGSEVQLVESGGGLVQP GGSLKLSCAASGFTFNTYAMNWVRQAPGKGLEWVARIRSKYNN YATYYADSVKDRFTISRDDSKNTAYLQMNNLKTEDTAVYYCVRH GNFGNSYVSWFAYWGQGTLVTVSA |
| SEQ ID NO: 429 | CDH17#8 (knob) / CD3#3 full length | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLWCLVKGFYPSDIAVEWESNGQPENNYKTTP PVLDSDGSFFLYSKLTVDKSRWQQGNVFSCSVMHEALHNHYTQ KSLSLSPGGGGSGGGGSGGGGSGGGGSEAVVTQEPSLTVSP GGTVTLTCRSSTGAVTTSNYANWVQQKPGQLPRGLIGGTNKRA PWVPARFSGSLLGGKAALTLSGAQPEDEAEYYCALWYSNLWVF GGGTKLTVLGGSEGKSSGSGSESKSTGGSEVQLVESGGGLVQP GGSLKLSCAASGFTFNTYAMNWVRQAPGKGLEWVARIRSKYNN YATYYADSVKDRFTISRDDSKNTAYLQMNNLKTEDTAVYYCVRH GNFGNSYVSWFAYWGQGTLVTVSA |
| SEQ ID NO: 430 | CDH17#8 (knob) / CD3#4 full length | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLWCLVKGFYPSDIAVEWESNGQPENNYKTTP PVLDSDGSFFLYSKLTVDKSRWQQGNVFSCSVMHEALHNHYTQ KSLSLSPGGGGSGGGGSGGGGSGGGGSEAVVTQEPSLTVSP GGTVTLTCRSSTGAVTTSNYANWVQQKPGQLPRGLIGGTNKRA PGVPARFSGSLLGGKAALTLSGAQPEDEAEYYCALWYSNLWVF |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| | | GCGTKLTVLGGSEGKSSGSGSESKSTGGSEVQLVESGGGLVQP GGSLKLSCAASGFTFNTYAMNWVRQAPGKCLEWVARIRSKYNN YATYYADSVKDRFTISRDDSKNTAYLQMNNLKTEDTAVYYCVRH GNFGNSYVSWFAYWGQGTLVTVSA |
| SEQ ID NO: 431 | CDH17#8 (knob) / CD3#5 full length | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLWCLVKGFYPSDIAVEWESNGQPENNYKTTP PVLDSDGSFFLYSKLTVDKSRWQQGNVFSCSVMHEALHNHYTQ KSLSLSPGGGGSGGGGSGGGGSGGGGSQAVVTQEPSLTVSP GGTVTLTCRSSTGAVTTSNYANWVQQKPGQLPRGLIGGTNKRA PGVPARFSGSLLGGKAALTLSGAQPEDEAEYYCALWYSNLWVF GGGTKLTVLGGSEGKSSGSGSESKSTGGSEVQLVESGGGLVQP GGSLKLSCAASGFTFNTYAMNWVRQAPGKGLEWVARIRSKYNN YATYYADSVKGRFTISRDDSKNTAYLQMNNLKTEDTAVYYCVRH GNFGNSYVSWFAYWGQGTLVTVSA |
| SEQ ID NO: 432 | CDH17#8 (knob) / CD3#6 full length | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLWCLVKGFYPSDIAVEWESNGQPENNYKTTP PVLDSDGSFFLYSKLTVDKSRWQQGNVFSCSVMHEALHNHYTQ KSLSLSPGGGGSGGGGSGGGGSGGGGSQAVVTQEPSLTVSP GGTVTLTCRSSTGAVTTSNYANWVQQKPGQLPRGLIGGTNKRA PGVPARFSGSLLGGKAALTLSGAQPEDEAEYYCALWYSNLWVF GCGTKLTVLGGSEGKSSGSGSESKSTGGSEVQLVESGGGLVQP GGSLKLSCAASGFTFNTYAMNWVRQAPGKGLEWVARIRSKYNN YATYYADSVKGRFTISRDDSKNTAYLQMNNLKTEDTAVYYCVRH GNFGNSYVSWFAYWGQGTLVTVSA |
| SEQ ID NO: 433 | CDH17#8 (knob) / CD3#7 full length | EIVMTQSPATLSVSPGERATLSCRASQSVLYSSNQKQYLAWYQ QKPGQAPRLLIYGASTRETGIPARFSGSGSGTEFTLTISSLQSEDF AVYYCQQYYSYPWTFGQGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLV QSGAEVKKPGSSVKVSCKASGYTFSDHTIHWVRQAPGQGLEWM GYIYPRLGSTKYAEKFQGRVTITADKSTSTAYMELSSLRSEDTAV YYCARWGYYYGSSRYYFDYWGQGTLVTVSSASTKGPSVFPLAP SSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLT VLHQDWLNGKEYKCKVSNKALPAPIEKTISKAKGQPREPQVYTLP PSREEMTKNQVSLWCLVKGFYPSDIAVEWESNGQPENNYKTTP PVLDSDGSFFLYSKLTVDKSRWQQGNVFSCSVMHEALHNHYTQ KSLSLSPGGGGSGGGGSGGGGSGGGGSQAVVTQEPSLTVSP |

TABLE 1-continued

Amino acid sequences and SEQ ID NOs of CDRs, variable heavy chain (VH), variable light chain (VL), light chain (LC), heavy chain (HC), single chain Fv (scFv), as well as particularly preferred combinations thereof, comprised in the binding molecules of the invention:

| SEQ ID Number | Brief description of sequence | Sequence |
|---|---|---|
| | | GGTVTLTCRSSTGAVTTSNYANWVQQKPGQLPRGLIGGTNKRA PWVPARFSGSLLGGKAALTLSGAQPEDEAEYFCALWYSNLWVF GGGTKLTVLGGSEGKSSGSGSESKSTGGSEVQLVESGGGLVQP GGSLKLSCAASGFTFNTYAMNWVRQAPGKGLEWVARIRSKYNN YATYYADSVKDRFTISRDDSKNTAYLQMNNLKTEDTAVYYCVRH GNFGNSYVSWFAYWGQGTLVTVSA |
| SEQ ID NO: 434 | Fc domain knob | ASTKGPSVFPLAPSSKSTSGGTAALGCLVKDYFPEPVTVSWNSG ALTSGVHTFPAVLQSSGLYSLSSVVTVPSSSLGTQTYICNVNHKP SNTKVDKRVEPKSCDKTHTCPPCPAPEAAGGPSVFLFPPKPKDT LMISRTPEVTCVVVDVSHEDPEVKFNWYVDGVEVHNAKTKPREE QYNSTYRVVSVLTVLHQDWLNGKEYKCKVSNKALPAPIEKTISKA KGQPREPQVYTLPPSREEMTKNQVSLWCLVKGFYPSDIAVEWE SNGQPENNYKTTPPVLDSDGSFFLYSKLTVDKSRWQQGNVFSC SVMHEALHNHYTQKSLSLSPG |
| SEQ ID NO: 435 | Fc domain hole | ASTKGPSVFPLAPSSKSTSGGTAALGCLVKDYFPEPVTVSWNSG ALTSGVHTFPAVLQSSGLYSLSSVVTVPSSSLGTQTYICNVNHKP SNTKVDKRVEPKSCDKTHTCPPCPAPEAAGGPSVFLFPPKPKDT LMISRTPEVTCVVVDVSHEDPEVKFNWYVDGVEVHNAKTKPREE QYNSTYRVVSVLTVLHQDWLNGKEYKCKVSNKALPAPIEKTISKA KGQPREPQVYTLPPSREEMTKNQVSLSCAVKGFYPSDIAVEWES NGQPENNYKTTPPVLDSDGSFFLVSKLTVDKSRWQQGNVFSCS VMHEALHNRFTQKSLSLSPG |
| SEQ ID NO: 436 | Trop2#11 full length (hole) | DIVLTQSPPSLAVSLGQRATISCRASESVDSSVNRFMHWYQQKP GQPPKLLIYRASNLESGIPARFSGSGSRTDFTLTINPVEADDVATY YCQQSNEDPYTFGGGTKLEIKRTVAAPSVFIFPPSDEQLKSGTAS VVCLLNNFYPREAKVQWKVDNALQSGNSQESVTEQDSKDSTYS LSSTLTLSKADYEKHKVYACEVTHQGLSSPVTKSFNRGECGGGG SEGKSSGSGSESKSTEGKSSGSGSESKSTGGGGSDVQLQESGP GLVKPSQSLSLTCSVTGYSITSGYYWNWIRQFPGNKLEWMGYIS YDGRNNYNPSLKNRISITRDTSENQFFLKLNSVTPEDTATYYCAR DTTAYFDYWGQGTTLTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSCDKTHTCPPCP APEAAGGPSVFLFPPKPKDTLMISRTPEVTCVVVDVSHEDPEVKF NWYVDGVEVHNAKTKPREEQYNSTYRVVSVLTVLHQDWLNGKE YKCKVSNKALPAPIEKTISKAKGQPREPQVYTLPPSREEMTKNQV SLSCAVKGFYPSDIAVEWESNGQPENNYKTTPPVLDSDGSFFLV SKLTVDKSRWQQGNVFSCSVMHEALHNRFTQKSLSLSPG |
| SEQ ID NO: 437 | CDH17#1 (knob) / CD3#1 full length | DIVMSQSPSSLAVSVGEKVTMSCKSSQSLLYSSNQKNYLAWYQQ KPGQSPKLLIYWASTRESGVPDRFTGSGSGTDFTLTISSVKAEDL AVYYCQQYYSYPWTFGGGTKLEIKRTVAAPSVFIFPPSDEQLKSG TASVVCLLNNFYPREAKVQWKVDNALQSGNSQESVTEQDSKDS TYSLSSTLTLSKADYEKHKVYACEVTHQGLSSPVTKSFNRGECG GGGSEGKSSGSGSESKSTEGKSSGSGSESKSTGGGGSQVQLQ QSDAELVKPGASVKISCKVSGYTFTDHTIHWMKQRPEQGLEWIG YIYPRDGSTKYNEKFKGKATLTADKSSSTAYMQLNSLTSEDSAVY FCARWGYYYGSSRYYFDYWGQGTTLTVSSASTKGPSVFPLAPS SKSTSGGTAALGCLVKDYFPEPVTVSWNSGALTSGVHTFPAVLQ SSGLYSLSSVVTVPSSSLGTQTYICNVNHKPSNTKVDKRVEPKSC DKTHTCPPCPAPEAAGGPSVFLFPPKPKDTLMISRTPEVTCVVVD VSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLWCLVKGFYPSDIAVEWESNGQPENNYKTTPPVL DSDGSFFLYSKLTVDKSRWQQGNVFSCSVMHEALHNHYTQKSL SLSPGGGGSGGGGSGGGGSGGGGSEAVVTQEPSLTVSPGGT VTLTCRSSTGAVTTSNYANWVQEKPGQLPRGLIGGTNKRAPWV PARFSGSLLGGKAALTLSGAQPEDEAEYFCALWYSNLWVFGGG TKLTVLGGSEGKSSGSGSESKSTGGSEVQLVESGGGLVQPGGS LKLSCAASGFTFNTYAMNWVRQAPGKGLEWVARIRSKYNNYATY YADSVKDRFTISRDDSKNTAYLQMNNLKTEDTAVYYCVRHGNFG NSYVSWFAYWGQGTLVTVSA |

The preferred antigen binding sites disclosed herein as Trop2 #1, Trop2 #8 to Trop2 #18, CDH17 #1, CDH17 #8 as well as CD3 #1 to CD3 #43 have all been identified and tested by the present inventors as suitable antigen binding sites for use in the trispecific binding molecules of the present invention. In particular, said antigen binding sites are connected by flexible elements of the polypeptide chain or linkers, which do not interfere with the structural and functional integrity of said antigen binding sites.

Mono-Specific Binding Molecules for TROP2

Further provided herein are antibody molecules (e.g., a full length antibody/immunoglobulin molecule having a Y shaped structure with two heavy and two light chains, or fragments thereof such as Fv, Fab, Fab', or F(ab')2 fragment, a single chain antibody, single chain variable fragment (scFv)) that bind specifically to TROP2. In some embodiments, the antibody molecules specific for TROP2 are recombinant monoclonal antibodies, chimeric, humanized or human antibody molecules.

In some embodiments the antibody molecule specific for TROP2 comprises any one of the following CDR combinations shown in (i) to (vi):

(i) heavy chain CDRs comprising the amino acid sequences of SEQ ID NO.:1 (CDR1), SEQ ID NO.:2 (CDR2) and SEQ ID NO.:3 (CDR3) and light chain CDRs comprising the amino acid sequences of SEQ ID NO.:4 (CDR1), SEQ ID NO.:5 (CDR2) and SEQ ID NO.:6 (CDR3);

(ii) heavy chain CDRs comprising the amino acid sequences of SEQ ID NO.:7 (CDR1), SEQ ID NO.:8 (CDR2) and SEQ ID NO.:9 (CDR3) and light chain CDRs comprising the amino acid sequences of SEQ ID NO.:10 (CDR1), SEQ ID NO.:11 (CDR2) and SEQ ID NO.:12 (CDR3);

(iii) heavy chain CDRs comprising the amino acid sequences of SEQ ID NO.:13 (CDR1), SEQ ID NO.:14 (CDR2) and SEQ ID NO.:15 (CDR3) and light chain CDRs comprising the amino acid sequences of SEQ ID NO.:16 (CDR1), SEQ ID NO.:17 (CDR2) and SEQ ID NO.:18 (CDR3);

(iv) heavy chain CDRs comprising the amino acid sequences of SEQ ID NO.:13 (CDR1), SEQ ID NO.:19 (CDR2) and SEQ ID NO.:15 (CDR3) and light chain CDRs comprising the amino acid sequences of SEQ ID NO.:20 (CDR1), SEQ ID NO.:17 (CDR2) and SEQ ID NO.:18 (CDR3);

(v) heavy chain CDRs comprising the amino acid sequences of SEQ ID NO.:21 (CDR1), SEQ ID NO.:22 (CDR2) and SEQ ID NO.:23 (CDR3) and light chain CDRs comprising the amino acid sequences of SEQ ID NO.:24 (CDR1), SEQ ID NO.:25 (CDR2) and SEQ ID NO.:26 (CDR3);
or (vi) heavy chain CDRs comprising the amino acid sequences of SEQ ID NO.:27 (CDR1), SEQ ID NO.:28 (CDR2) and SEQ ID NO.:29 (CDR3) and light chain CDRs comprising the amino acid sequences of SEQ ID NO.:30 (CDR1), SEQ ID NO.:25 (CDR2) and SEQ ID NO.:31 (CDR3).

In some embodiments the antibody molecule specific for TROP2 comprises:

i) an immunoglobulin heavy chain variable domain comprising the amino acid sequence of SEQ ID NO:83 and an immunoglobulin light chain variable domain comprising the amino acid sequence of SEQ ID NO:84;

(ii) an immunoglobulin heavy chain variable domain comprising the amino acid sequence of SEQ ID NO:85 and an immunoglobulin light chain variable domain comprising the amino acid sequence of SEQ ID NO:86;

(iii) an immunoglobulin heavy chain variable domain comprising the amino acid sequence of SEQ ID NO:87 and an immunoglobulin light chain variable domain comprising the amino acid sequence of SEQ ID NO:88;

(iv) an immunoglobulin heavy chain variable domain comprising the amino acid sequence of SEQ ID NO:89 and an immunoglobulin light chain variable domain comprising the amino acid sequence of SEQ ID NO:90;

(v) an immunoglobulin heavy chain variable domain comprising the amino acid sequence of SEQ ID NO:91 and an immunoglobulin light chain variable domain comprising the amino acid sequence of SEQ ID NO:92;

(vi) an immunoglobulin heavy chain variable domain comprising the amino acid sequence of SEQ ID NO:93 and an immunoglobulin light chain variable domain comprising the amino acid sequence of SEQ ID NO:94;

(vii) an immunoglobulin heavy chain variable domain comprising the amino acid sequence of SEQ ID NO:95 and an immunoglobulin light chain variable domain comprising the amino acid sequence of SEQ ID NO:94;

(viii) an immunoglobulin heavy chain variable domain comprising the amino acid sequence of SEQ ID NO:95 and an immunoglobulin light chain variable domain comprising the amino acid sequence of SEQ ID NO:96;

(ix) an immunoglobulin heavy chain variable domain comprising the amino acid sequence of SEQ ID NO:95 and an immunoglobulin light chain variable domain comprising the amino acid sequence of SEQ ID NO:97;

(x) an immunoglobulin heavy chain variable domain comprising the amino acid sequence of SEQ ID NO:98 and an immunoglobulin light chain variable domain comprising the amino acid sequence of SEQ ID NO:97;

(xi) an immunoglobulin heavy chain variable domain comprising the amino acid sequence of SEQ ID NO:95 and an immunoglobulin light chain variable domain comprising the amino acid sequence of SEQ ID NO:99;
or (xii) an immunoglobulin heavy chain variable domain comprising the amino acid sequence of SEQ ID NO:98 and an immunoglobulin light chain variable domain comprising the amino acid sequence of SEQ ID NO:96.

In some embodiments, the TROP2 specific antibodies as defined above further comprise human heavy chain constant domains (e.g., an IgG constant domain) and a human light chain constant domain (e.g. a kappa or lambda light chain constant domain). In some embodiments, the heavy chain constant domain is human IgG1 wildtype (e.g., as provided in SEQ ID NO:414), IgG1 KO (e.g. as provided in SEQ ID NO:415), IgG4 Pro wild type (e.g. as provided in SEQ ID NO:416), or IgG1 FcRnmut (e.g. as provided in SEQ ID NO:417). In some embodiments, the human light chain constant domain is human kappa (e.g., as provided in SEQ ID NO:418).

In some embodiments the TROP2 specific antibody has a heavy chain comprising the sequence of any one of SEQ ID NOs: 83, 85, 87, 89, 91, 93, 95 or 98 fused to the sequence of any one of SEQ ID Nos: 414, 415, 416 or 417 and a light chain comprising the sequence of any one of SEQ ID NOs: 84, 86, 88, 90, 92, 94, 96, 97 or 99 fused to the sequence of SEQ ID NO:418.

The TROP2 specific antibodies provided herein may be used for in vitro, in vivo or ex vivo labelling, localizing, identifying or targeting cells expressing TROP2 (e.g. in ELISA assays, FACS analysis, immunohistology or the like) by attaching a dye, a drug or another molecule with binding specificity for a different antigen. The TROP2 specific antibodies described herein alone do not have an effect on cell viability of cells expressing TROP2. In some embodiments, TROP2 specific antibodies specifically bind to the surface of a TROP2 expressing cell and are used for localizing and/or identifying such cells. In some embodiments, the TROP2 antibodies provided herein are used for identifying cells expressing TROP2 (e.g. tumor cells). In some embodiments, the TROP2 antibodies provided herein are used for delivering a drug or cytotoxic agent to a target cell (e.g. a tumor cell expressing TROP2) by attaching such drug or cytotoxic agent to said TROP2 antibody, thereby, for example, killing said target cell.

Also provided herein is a method of detecting trophoblast cell-surface antigen 2 (TROP2) in a sample, the method comprising the steps:
(a) contacting the sample with an anti-TROP2 antibody molecule as defined herein above;
(b) permitting formation of antibody-antigen complexes in the sample; and
(c) detecting the anti-TROP2 antibody.

Means and methods for detecting antibodies are well known in the art and include for example immunohistochemistry, Immunoblotting and ELISA.

Further provided herein is a kit of detecting trophoblast cell-surface antigen 2 (TROP2), wherein the kit comprises an anti-TROP2 antibody molecule as defined herein above, and instructions for use.

Mono-Specific Binding Molecules for CDH17

Further provided herein are antibody molecules (e.g., a full length antibody/immunoglobulin molecule having a Y shaped structure with two heavy and two light chains, or fragments thereof such as Fv, Fab, Fab', or F(ab')2 fragment, a single chain antibody, single chain variable fragment (scFv)) that bind specifically to CDH17. In some embodiments, the antibody molecules specific for CDH17 are recombinant monoclonal antibodies, chimeric, humanized or human antibody molecules.

In some embodiments the antibody molecule specific for CDH17 comprises any one of the following CDR combinations shown in (i) to (ii):
(i) heavy chain CDRs comprising the amino acid sequences of SEQ ID NO.:32 (CDR1), SEQ ID NO.:33 (CDR2) and SEQ ID NO.:34 (CDR3) and light chain CDRs comprising the amino acid sequences of SEQ ID NO.:35 (CDR1), SEQ ID NO.:36 (CDR2) and SEQ ID NO.:37 (CDR3);
and
(ii) heavy chain CDRs comprising the amino acid sequences of SEQ ID NO.:32 (CDR1), SEQ ID NO.:38 (CDR2) and SEQ ID NO.:34 (CDR3) and light chain CDRs comprising the amino acid sequences of SEQ ID NO.:39 (CDR1), SEQ ID NO.:40 (CDR2) and SEQ ID NO.:37 (CDR3).

In some embodiments the antibody molecule specific for CDH17 comprises
(i) an immunoglobulin heavy chain variable domain comprising the amino acid sequence of SEQ ID NO:100 and an immunoglobulin light chain variable domain comprising the amino acid sequence of SEQ ID NO:101;
or
(ii) an immunoglobulin heavy chain variable domain comprising the amino acid sequence of SEQ ID NO:102 and an immunoglobulin light chain variable domain comprising the amino acid sequence of SEQ ID NO:103.

In some embodiments, the CDH17 specific antibodies as defined above further comprise human heavy chain constant domains (e.g., an IgG constant domain) and a human light chain constant domain (e.g. a kappa or lambda light chain constant domain). In some embodiments, the heavy chain constant domain is human IgG1 wildtype (e.g., as provided in SEQ ID NO:414), IgG1 KO (e.g. as provided in SEQ ID NO:415), IgG4 Pro wild type (e.g. as provided in SEQ ID NO:416), or IgG1 FcRnmut (e.g. as provided in SEQ ID NO:417). In some embodiments, the human light chain constant domain is human kappa (e.g., as provided in SEQ ID NO:418).

In some embodiments the CDH17 specific antibody has a heavy chain comprising the sequence of any one of SEQ ID NOs: 100 or 102 fused to the sequence of any one of SEQ ID NOs; 414, 415, 416 or 417 and a light chain comprising the sequence of any one of SEQ ID NOs: 101 or 103 fused to the sequence of SEQ ID NO:418.

The CDH17 specific antibodies provided herein may be used for in vitro, in vivo or ex vivo labelling, localizing, identifying or targeting cells expressing CDH17 (e.g. in ELISA assays, FACS analysis, immunohistology or the like) by attaching a dye, a drug or another molecule with binding specificity for a different antigen. The CDH17 specific antibodies described herein alone do not have an effect on cell viability of cells expressing CDH17. In some embodiments, CDH17 specific antibodies specifically bind to the surface of a CDH17 expressing cell and are used for localizing and/or identifying such cells. In some embodiments, the CDH17 antibodies provided herein are used for identifying cells expressing CDH17 (e.g. tumor cells). In some embodiments, the CDH17 antibodies provided herein are used for delivering a drug or cytotoxic agent to a target cell (e.g. a tumor cell expressing CDH17) by attaching such drug or cytotoxic agent to said CDH17 antibody, thereby, for example, killing said target cell.

Also provided herein is a method of detecting cadherin-17 (CDH17) in a sample, the method comprising the steps:
(a) contacting the sample with an anti-CDH17 antibody molecule as defined herein above;
(b) permitting formation of antibody-antigen complexes in the sample; and
(c) detecting the anti-CDH17 antibody.

Means and methods for detecting antibodies are well known in the art and include for example immunohistochemistry, Immunoblotting and ELISA.

Further provided herein is a kit of detecting trophoblast cell-surface antigen 2 (TROP2), wherein the kit comprises an anti-TROP2 antibody molecule as defined herein above, and instructions for use.

Nucleic Acid Molecules, Expression Vectors and Host Cells of the Invention

The present invention further relates to a nucleic acid molecule encoding the binding molecule of the present invention, or a part thereof. The present invention further encompasses a set of nucleic acid molecules encoding the binding molecule of the present invention.

In accordance with the present invention, said nucleic acid molecule "encodes" the binding molecule of the invention or a part thereof, which means that the nucleic acid molecule is provided in an expressible form, i.e. in a form that ensures that the binding molecule (or the respective part thereof) of the present invention can be expressed therefrom.

The term "a part thereof" reflects the fact that not all elements of the binding molecule of the present invention need to be encoded on a single nucleic acid molecule, as will be appreciated by the skilled person. Instead, two or more nucleic acid molecules can be relied on to individually encode certain parts of the binding molecule of the present invention. Thus, the present invention also encompasses a set of isolated nucleic acid molecules, wherein the set together encodes all parts of the binding molecule of the present invention such that expression of this set of isolated nucleic acid molecules results in the generation of a complete binding molecule of the present invention. In other words, one or more nucleic acid molecule is provided herein, which encode(s) the individual polypeptide chains of the binding molecule of the present invention, including the heavy chains, light chains, scFvs, as well as combinations thereof, either separately on individual nucleic acid molecules or combined in one nucleic acid molecule.

Preferably, the binding molecule of the present invention is encoded by two different isolated nucleic acid molecules, wherein the first nucleic acid molecule encodes the full length chain comprising the antigen binding site that specifically binds to TROP2 (including single chain Fab and Fc domain) and the second nucleic acid molecule encodes the full length chain comprising the antigen binding site that specifically binds to CDH17 (including single chain Fab and Fc domain), linked to the full length chain comprising the antigen binding site that specifically binds to CD3 (preferably as a scFv). Upon expression, both expressed polypeptides will form a full binding molecule of the present invention, for example via disulphide bonds between the constant domains etc.

Preferably, the nucleic acid molecule is a DNA molecule comprising coding sequences. More preferably, said DNA molecule additionally comprises regulatory sequences and, optionally, natural or artificial introns (such as e.g. the β-Globin intron from *Homo sapiens* with embedded miRNA-557 expression cassette). It may have its original codons or may have an optimized codon usage that has been specifically adapted for expression in the intended host cell or host organism. Such nucleic acid molecules of the invention can be readily prepared or obtained by the skilled person relying on methods known per se, such as e.g. by automated DNA synthesis, isolation from a nature source and/or recombinant DNA technology, based on the information on the amino acid sequences for the binding molecule of the invention given herein.

The nucleic acid molecules of the invention include, but are not limited to, the DNA molecules encoding the polypeptide sequences shown in the sequence listing. The present invention furthermore contemplates nucleic acid molecules complementary to the above-defined DNA molecules as well as nucleic acid molecules hybridizing thereto under high stringency binding and washing conditions, as defined in WO 2007/042309. Preferred molecules (from an mRNA perspective) are those that have at least 75% or 80% (preferably at least 85%, more preferably at least 90% and most preferably at least 95%) homology or sequence identity with one of the DNA molecules described herein. By way of example, if the aim is to express the binding molecule of the present invention in eukaryotic cells, the DNA sequences will have to be designed to match codon usage in eukaryotic cells. If it is desired to express the antibodies in *E. coli*, or other prokaryotic systems, these sequences will have to be designed to match codon usage *E. coli*, or the respective prokaryotic system. Variants of DNA molecules of the invention can be constructed in several different ways, as described e.g. in WO 2007/042309.

Preferably, the nucleic acid(s) is/are isolated, the term "isolated" being defined further above.

The present invention further relates to an expression vector comprising the nucleic acid molecule(s) of the invention.

In accordance with the present invention, the vector is an expression vector, i.e. a vector that can provide for expression of the respective polypeptide from the encoding nucleic acid molecule in vitro and/or in vivo (e.g. in a suitable host cell, host organism and/or expression system). Expression vectors include plasmids, retroviruses, cosmids, EBV derived episomes, and the like. The expression vector and expression control sequences are typically selected to be compatible with the host cell. Expression vectors generally comprise at least one nucleic acid molecule of the invention that is operably linked to one or more suitable regulatory element(s), such as promoter(s), enhancer(s), terminator(s), and the like. Specific examples of such regulatory elements and other elements, such as integration factor(s), selection marker(s), signal or leader sequence(s), reporter gene(s), and the like, useful or necessary for expressing polypeptides of the invention, are disclosed e.g. on pp. 131 to 133 of WO2006/040153.

Non-limiting examples for promoter sequences (exemplified for expression in mammalian cells) are promoters and/or enhancers derived from CMV (such as the CMV Promoter/Enhancer of human cytomegalovirus or the CMV Simian Virus 40 (SV40) promoter/enhancer), adenovirus, (e.g., the adenovirus major late promoter (AdMLP)), polyoma and strong mammalian promoters such as native immunoglobulin and actin promoters. Examples for polyadenylation signals are Hamster Growth Hormone or Bovine Growth Hormone polyA, SV40 late or early polyA; alternatively, 3"UTRs of immunoglobulin genes etc. can be used.

The recombinant expression vectors may also carry sequences that regulate replication of the vector in host cells (e. g. origins of replication, such as the ColE1 (pUC) origin of replication) and selectable marker genes (such as e.g. a β-Lactamase gene to confer ampicillin resistance for amplification of the plasmids in *E. coli*). The recombinant expression vector may also encode a signal peptide that facilitates secretion of the resulting polypeptide. The nucleic acid molecule encoding the respective polypeptide chain may be cloned into the vector such that the signal peptide is linked in-frame to the amino terminus of the mature full length nucleic acid molecule chain. The signal peptide may be an immunoglobulin signal peptide or a heterologous peptide from a non-immunoglobulin protein. Alternatively, the DNA sequence encoding the full length chains of the protein of the invention may already contain a signal peptide sequence.

As indicated above, the coding sequences inserted in the vector can e.g. be synthesized by standard methods, or isolated from natural sources or produced semi-synthetically, i.e. by combining chemical synthesis and recombinant techniques. Ligation of the coding sequences to transcriptional regulatory elements and/or to other amino acid encoding sequences can be carried out using established methods. One approach often employed is, for example, to use vectors that encode a functionally complete human CH (constant heavy) immunoglobulin sequence, with appropriate restriction sites engineered so that any antigen binding site such as a single chain Fab sequence or any heavy/light chain variable domain can be easily inserted and expressed. For the antibody heavy chain, it can be, without limitation, any IgG isotype (IgG1, IgG2, IgG3, IgG4) or other immunoglobulins, including allelic variants.

In those cases where more than one nucleic acid molecule is required to make up the binding molecule of the present invention, these more than one nucleic acid molecules can be inserted into different or into the same expression vector. In the latter case, they may be under the control of the same regulatory elements, e.g. promoters, enhancers, terminators and the like, or they may each have their own set of regulatory elements. In accordance with the present invention it is particularly preferred that, in those cases where more than one nucleic acid molecule encodes the individual elements of the binding molecule of the present invention (i.e. the polypeptide chain comprising the antigen binding site specifically binding to TROP2, the polypeptide chain comprising the antigen binding site specifically binding to CHD17 and the polypeptide chain comprising the antigen binding site specifically binding to CD3), all the individual nucleic acid molecules required to form the binding molecule of the present invention are present on a single expression vector and, preferably, each nucleic acid molecule has its own set of regulatory elements.

Expression vectors comprising these DNA molecules can be introduced into host cells, e.g. bacterial cells or (higher) eukaryotic cells, e.g. mammalian cells, according to transfection methods well known in the art, including liposome-mediated transfection, polycation-mediated transfection, protoplast fusion, microinjections, calcium phosphate precipitation, electroporation or transfer by viral vectors.

Accordingly, the present invention also relates to a host cell transfected with the expression vector(s) of the invention.

Host cells can be any suitable cells known in the art, including prokaryotic cells such as bacteria, as well as eukaryotic cells, such as yeast cells or mammalian cells. Non-limiting examples of mammalian cells include, without being limiting, human, mice, rat, monkey and rodent cells lines. Specific mammalian cell lines available as host cells for expression are well known in the art and include, inter alia, Chinese hamster ovary (CHO) cells, NS0, SP2/0 cells, HeLa cells, baby hamster kidney (BHK) cells, monkey kidney cells (COS), human carcinoma cells (e. g., Hep G2 and A-549 cells), 313 cells or the derivatives/progenies of any such cell line. Appropriate culture mediums and conditions for the above-described host cells are known in the art.

Methods for Producing the Binding Molecule of the Present Invention

The present invention also relates to a method of producing the binding molecule of the invention, the method comprising the steps:
(a) culturing the host cell of the invention under conditions allowing expression of the binding molecule of the invention;
(b) optionally recovering said molecule; and, optionally,
(c) further purifying and/or modifying and/or formulating said binding molecule.

The proteins of the invention are produced by culturing the host cells for a period of time sufficient to allow for expression of the protein by the host cells.

Suitable conditions for culturing a prokaryotic or eukaryotic host are well known to the person skilled in the art. To increase the yield and the solubility of the expression product, the medium can be buffered or supplemented with suitable additives known to enhance or facilitate both. In general, the skilled person is also aware that these conditions may have to be adapted to the needs of the host and the requirements of the molecule to be expressed. In case an inducible promoter controls the nucleic acid molecule(s) of the invention in the vector(s) present in the host cell, expression of the molecule of interest can be induced by addition of an appropriate inducing agent. Suitable expression protocols and strategies are known to the skilled person.

Subsequently, the binding molecules of the present invention are recovered and, where necessary, further purified. Preferably, they are recovered from the culture medium as a secreted molecule. However, they can also be recovered from host cell lysates if, for example, they were expressed without a secretory signal. It will be appreciated that the term "recovering said molecule" refers to the isolation of the binding molecule of the present invention encoded by the nucleic acid molecule(s) of the invention, i.e. the binding molecule that is present in the host cell of the invention due to the transformation or transfection of said host cell with the nucleic acid molecule or the vector of the invention.

An optional step of purifying the binding molecule of the present invention further helps in obtaining a substantially homogenous preparations of the molecule. Means and methods for purifying a molecule of interest are well known and the skilled person can, for example, use standard protein purification methods used for recombinant proteins and host cell proteins and adjust it in a way that is appropriate for the respective molecule. By way of example, state-of-the art purification methods useful for obtaining binding molecules of the present invention include, as a first step, removal of cells and/or particulate cell debris from the culture medium or lysate, followed by purification from contaminant soluble proteins, polypeptides and nucleic acids, for example, by fractionation on immunoaffinity or ion-exchange columns, ethanol precipitation, reverse phase HPLC, Sephadex chromatography, chromatography on silica or on a cation exchange resin.

As a final optional step in the process for obtaining a binding molecule of the present invention, the purified protein molecule may be dried, e.g. lyophilized, as described below for therapeutic applications, or otherwise formulated as desired. Furthermore, the resulting binding molecule of the present invention may be subjected to further modifications, for example to remove unwanted post-translational modifications and the like.

Pharmaceutical Compositions and Medical Uses of the Binding Molecule of the Present Invention or of the Pharmaceutical Composition The present invention further relates to a pharmaceutical composition comprising or consisting of one or more binding molecules of the invention. In one embodiment, said binding molecule(s) is/are the only pharmaceutically active agent(s). In an alternative embodiment, said composition comprises, in addition to said binding molecule(s), one or more further pharmaceutically active agents, for example as defined further below.

In accordance with the present invention, the term "pharmaceutical composition" relates to a composition for administration to a patient, preferably a human patient. The pharmaceutical composition of the invention comprises the compounds recited above, alone or in combination. It may, optionally, comprise further molecules capable of altering the characteristics of the compounds of the invention thereby, for example, stabilizing, modulating and/or activating their function. The composition may be in solid, liquid or gaseous form and may be, inter alia, in the form of (a) powder(s), e.g. a lyophilized powder, (a) solution(s), (a) tablet(s) or (an) aerosol(s).

Preferably, the composition is a lyophilized powder or a solution. To be used in therapy, the binding molecule or antibody of the invention is formulated into pharmaceutical compositions appropriate to facilitate administration to animals or humans. Thus, the pharmaceutical composition of the present invention preferably also comprises a pharmaceutically acceptable carrier. Compositions comprising such carriers can be formulated by well-known conventional methods. Typically, the pharmaceutical composition comprising the binding molecule of the invention can be formulated by mixing the binding molecule with such pharmaceutically acceptable carriers, as well as (optionally) excipients or stabilizers. By "pharmaceutically acceptable carrier" is meant a non-toxic solid, semisolid or liquid filler, diluent, encapsulating material or formulation auxiliary of any type. Also other excipients, modifiers or stabilizers are nontoxic at the dosages and concentrations employed.

Pharmaceutically acceptable carriers, excipients, modifiers and stabilizers include, without limitation, buffer systems such as phosphate, citrate, acetate and other inorganic or organic acids and their salts; antioxidants including ascorbic acid and methionine; preservatives such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol; proteins, such as serum albumin, gelatin, or immunoglobulins; hydrophilic polymers such as polyvinylpyrrolidone or polyethylene glycol (PEG); amino acids such as glycine, glutamine, asparagine, histidine, arginine, or lysine; monosaccharides, disaccharides, oligosaccharides or polysaccharides and other carbohydrates including glucose, mannose, sucrose, trehalose, dextrins or dextrans; chelating agents such as EDTA; sugar alcohols such as, mannitol or sorbitol; salt-forming counter-ions such as sodium; metal complexes (e.g., Zn-protein complexes); and/or ionic or non-ionic surfactants such as TWEEN™ (polysorbates), PLURONICS™ or fatty acid esters, fatty acid ethers or sugar esters. Also organic solvents can be contained in the formulation such as ethanol or isopropanol. The excipients may also have a release-modifying or absorption-modifying function.

Usually, aqueous solutions or suspensions will be preferred. Generally, suitable formulations for therapeutic proteins such as the binding molecules of the invention are buffered protein solutions, such as solutions including the protein in a suitable concentration (such as from 0.001 to 400 mg/ml, preferably from 0.005 to 200 mg/ml, more preferably 0.01 to 200 mg/ml, more preferably 1.0-100 mg/ml, such as 1.0 to 10.0 mg/ml (i.v. administration) or 100 mg/ml (s.c. administration) and an aqueous buffer such as:
  phosphate buffered saline, pH 7.4,
  other phosphate buffers, pH 6.2 to 8.2,
  acetate buffers, pH 3.2 to 7.5, preferably pH 4.8 to 5.5
  histidine buffers, pH 5.5 to 7.0,
  succinate buffers, pH 3.2 to 6.6, or
  citrate buffers, pH 2.1 to 6.2,
and, optionally, salts (e.g. NaCl) and/or stabilizing agents (such as e.g. sucrose, trehalose, lysine) and/or other polyalcohols (such as e.g. mannitol and glycerol) for providing isotonicity of the solution, and optionally detergents, e.g. to prevent aggregation (e.g. 0.02% Tween-20 or Tween-80).

Preferred buffered protein solutions for i.v. administration are solutions including about 10 mg/ml of the binding molecule of the invention dissolved in 10 mM citrate buffer, pH 5.5, 207 mM sucrose, 25 mM lysine HCl and 0.02% polysorbate 20. Formulations for subcutaneous application may include significantly higher concentrations of the antibody of the invention, such as up to 100 mg/ml or even above 100 mg/ml. However, it will be clear to the person skilled in the art that the ingredients and the amounts thereof as given above do only represent one, preferred option. Alternatives and variations thereof will be immediately apparent to the skilled person, or can easily be conceived starting from the above disclosure.

The pharmaceutical composition of the present invention can be administered to the subject using any suitable mode of administration, including for example parenteral administration by infusion or injection (intravenous, intraarticular, intramuscular, subcutaneous, intrasternal, intraperitoneal, intradermal), as well as transdermal, intranasal, buccal, or oral administration or administration by inhalation. For the administration of a solution or a reconstituted lyophilized powder, parenteral modes of administration are preferred.

Generally, for the treatment, prevention and/or alleviation of the diseases, disorders and conditions mentioned herein and depending on the specific disease, disorder or condition to be treated, the potency of the specific binding molecule of the invention to be used, the specific route of administration and the specific pharmaceutical formulation or composition used, has an impact on the actual dose to be administered. Furthermore, the actual pharmaceutically effective amount or therapeutic dosage will also depend on factors known by those skilled in the art such as age and weight of the patient. In any case, the binding molecule of the invention or the pharmaceutical composition of the invention will be administered at dosages and in a manner which allows a pharmaceutically effective amount to be delivered based upon patient's unique condition. Preferably, binding molecules of the invention or the pharmaceutical composition of the invention will be administered in an amount between 0.005 and 20.0 mg per kilogram of body weight and dose, preferably between 0.05 and 10.0 mg/kg/dose, and more preferably between 0.5 and 5 mg/kg/dose, either continuously (e.g. by infusion) or more preferably as single doses. The administration interval may be, for example, twice a week, weekly, or monthly doses, but can significantly vary, especially, depending on the before-mentioned parameters. Thus, in some cases it may be sufficient to use less than the minimum dose given above, whereas in other cases the upper limit may have to be exceeded. When administering large amounts it may be advisable to divide them up into a number of smaller doses spread over the day. Preferably, administration is once per week at a dose range from between 0.005 and 20.0 mg per kilogram of body weight and dose, preferably between 0.05 and 10.0 mg/kg/dose, and more preferably between 0.5 and 5 mg/kg/dose.

The efficacy of the binding molecules of the invention, and of compositions comprising the same, can be tested using any suitable in vitro assay, cell-based assay, in vivo assay and/or animal model known per se, or any combination thereof, depending on the specific disease involved. Suitable assays and animal models will be clear to the skilled person, and for example include the assays and animal models used in the Examples below.

The binding molecules of the invention or the pharmaceutical composition of the invention may be used on their own or in combination with other pharmacologically active ingredients, such as state-of-the-art or standard-of-care compounds, such as e.g. cytostatic or cytotoxic substances, cell proliferation inhibitors, anti-angiogenic substances, steroids, immune modulators/checkpoint inhibitors, and the like.

Hence a further aspect of the invention provides the binding molecules of the invention or a pharmaceutical composition comprising a binding molecule of the invention, together with one or more further active ingredients, and optionally a pharmaceutically acceptable carrier. Cytostatic and/or cytotoxic active substances which may be administered as combination partners in accordance with the present invention include, without being restricted thereto, hormones, hormone analogues and antihormones, aromatase inhibitors, LHRH agonists and antagonists, inhibitors of growth factors (growth factors such as for example platelet derived growth factor (PDGF), fibroblast growth factor (FGF), vascular endothelial growth factor (VEGF), epidermal growth factor (EGF), insuline-like growth factors (IGF), human epidermal growth factor (HER, e.g. HER2, HER3, HER4) and hepatocyte growth factor (HGF)), inhibitors are for example (anti-)growth factor antibodies, (anti-)growth factor receptor antibodies and tyrosine kinase inhibitors, such as for example cetuximab, gefitinib, afatinib, nintedanib, imatinib, lapatinib, bosutinib and trastuzumab; antimetabolites (e.g. antifolates such as methotrexate, raltitrexed, pyrimidine analogues such as 5-fluorouracil (5-FU), gemcitabine, irinotecan, doxorubicin, TAS-102, capecitabine and gemcitabine, purine and adenosine analogues such as mercaptopurine, thioguanine, cladribine and pentostatin, cytarabine (ara C), fludarabine); antitumor antibiotics (e.g. anthracyclins); platinum derivatives (e.g. cisplatin, oxaliplatin, carboplatin); alkylation agents (e.g. estramustin, meclorethamine, melphalan, chlorambucil, busulphan, dacarbazin, cyclophosphamide, ifosfamide, temozolomide, nitrosoureas such as for example carmustin and lomustin, thiotepa); antimitotic agents (e.g. Vinca alkaloids such as for example vinblastine, vindesin, vinorelbin and vincristine; and taxanes such as paclitaxel, docetaxel); angiogenesis inhibitors, including bevacizumab, ramucirumab and aflibercept, tubuline inhibitors; DNA synthesis inhibitors, PARP inhibitors, topoisomerase inhibitors (e.g. epipodophyllotoxins such as for example etoposide and etopophos, teniposide, amsacrin, topotecan, irinotecan, mitoxantrone), serine/threonine kinase inhibitors (e.g. PDK1 inhibitors, Raf inhibitors, A-Raf inhibitors, B-Raf inhibitors, C-Raf inhibitors, mTOR inhibitors, mTORC1/2 inhibitors, PI3K inhibitors, PI3Kα inhibitors, dual mTOR/PI3K inhibitors, STK33 inhibitors, AKT inhibitors, PLK1 inhibitors (such as volasertib), inhibitors of CDKs, including CDK9 inhibitors, Aurora kinase inhibitors), tyrosine kinase inhibitors (e.g. PTK2/FAK inhibitors), protein protein interaction inhibitors, MEK inhibitors, ERK inhibitors, FLT3 inhibitors, BRD4 inhibitors, IGF-1R inhibitors, Bcl-xL inhibitors, Bcl-2 inhibitors, Bcl-2/Bcl-xL inhibitors, ErbB receptor inhibitors, BCRABL inhibitors, ABL inhibitors, Src inhibitors, rapamycin analogs (e.g. everolimus, temsirolimus, ridaforolimus, sirolimus), androgen synthesis inhibitors, androgen receptor inhibitors, DNMT inhibitors, HDAC inhibitors, ANG1/2 inhibitors, CYP17 inhibitors, radiopharmaceuticals, immunotherapeutic agents such as immune checkpoint inhibitors (e.g. CTLA4, PD1, PD-L1, LAG3, and TIM3 binding molecules/immunoglobulins, such as ipilimumab, nivolumab, pembrolizumab) and various chemotherapeutic agents such as amifostin, anagrelid, clodronat, filgrastin, interferon, interferon alpha, leucovorin, rituximab, procarbazine, levamisole, mesna, mitotane, pamidronate and porfimer; proteasome inhibitors (such as Bortezomib); Smac and BH3 mimetics; agents restoring p53 functionality including mdm2-p53 antagonist; inhibitors of the Wnt/beta-catenin signaling pathway; stromal modulators such as (preferably bi-specific) molecules targeting CD137 and FAP; and/or cyclin-dependent kinase 9 inhibitors.

Preferred in accordance with the present invention are treatments with the binding molecules of the invention or the pharmaceutical composition of the invention in combination with a drug selected from below:
(i) anti-VEGF antibodies (bevacizumab and other anti-angiogenic substances) with or without chemotherapy combination (including doxorubicin/cyclophosphamide combination and/or capecitabine/docetaxel combination in neoadjuvant setting; taxane/platinum regimen for first and later line treatment), e.g. in particular in breast cancer patients;
(ii) chemotherapeutics used for the treatment of CRC (including 5-fluorouracil, irinotecan, doxorubicin and TAS-102);
(iii) anti-EGFR antibodies (cetuximab and panitumumab in KRAS wild-type tumors) with or without chemotherapy combination (including irinotecan), anti-VEGF antibody combination (bevacizumab and other anti-angiogenic substances) or regorafenib combination, e.g. for the treatment of CRC patients; and/or
(iv) immunotherapeutic agents, including anti-PD-1 and anti-PD-L1 agents and anti LAG3 agents, such as ezabenlimab, pembrolizumab and nivolumab and other antibodies as disclosed in WO2017/198741, e.g. for treatment of CRC patients; and/or
(v) stromal modulators such as (preferably bi-specific) molecules targeting CD137 and FAP.

In particularly preferred embodiments, the binding molecule of the invention or the pharmaceutical composition of the invention is used for the treatment of cancer in combination with an immune checkpoint inhibitor, preferably with a PD-1 antagonist, such as an anti-PD-1 antibody or an anti-PDL-1 antibody. Preferably said anti-PD-1 antibody is selected from the group consisting of pembrolizumab, nivolumab, pidilizumab, or PD1-1, PD1-2, PD1-3, PD1-4, and PD1-5 as described in WO2017/198741 (incorporated herein by reference), more preferably said anti-PD-1 antibody is ezabenlimab. Preferably said anti-PDL-1 antibody is selected from the group consisting of atezolizumab, avelumab and durvalumab.

The present invention further relates to the binding molecule of the invention, or the pharmaceutical composition of the invention, for use in medicine. The present invention further relates to the binding molecule of the invention, or the pharmaceutical composition of the invention, for use in the preparation of a medicament.

Furthermore, the present invention also relates to the binding molecule of the invention, or the pharmaceutical composition of the invention, for use in a method of treating, ameliorating or preventing cancer. The present invention further relates to a method of treating, preventing or ameliorating cancer comprising administering a therapeutically effective amount of the binding molecule of the invention, or of the pharmaceutical composition of the invention, to a patient in need thereof.

The "therapeutically effective amount" of the molecule to be administered is the minimum amount necessary to prevent, ameliorate, or treat clinical symptoms of cancer, in particular the minimum amount which is effective to the specific cancer to be treated.

As used herein, the term "cancer" is meant to include all types of cancerous growths or oncogenic processes, metastatic tissues or malignantly transformed cells, tissues, or organs, irrespective of histopathologic type or stage of invasiveness. Thus, all cancers, tumours, neoplasms, etc., mentioned below which are characterized by their specific location/origin in the body are meant to be included both as the primary tumours and the metastatic tumours derived therefrom.

Cancers whose growth can be inhibited using the multispecific binding molecules described herein are any TROP2/CDH17 expressing tumours including but not limited to T cell lymphoma, myeloid leukaemia, breast cancer; ovarian cancer, oral squamous carcinoma and gastro-intestinal cancers. Gastro-intestinal cancers include but are not limited to oesophageal cancer (e.g., gastroesophageal junction cancer), stomach (gastric) cancer, hepatocellular carcinoma, biliary tract cancer (e.g., cholangiocarcinoma), gallbladder cancer, pancreatic cancer or colorectal cancer (CRC). In some embodiments, the following cancers, tumours, and other proliferative diseases may be treated with multi-specific binding molecules of the invention: head and neck cancer, preferably HNSCC; lung cancer; preferably NSCLC; breast cancer; thyroid cancer; cervical cancer; ovarian cancer; endometrial cancer; liver cancer (hepatoblastoma or hepatocellular carcinoma); pancreatic cancer; prostate cancer; gastric sarcoma; gastrointestinal stromal tumor, oesophageal cancer; colon cancer; colorectal cancer; renal cancer; skin cancer; brain tumor; glioblastoma; Non-Hodgkin lymphomas (T or B cell lymphoma); leukaemia (chronic or acute myeloid leukaemia's, nonlymphocytic leukaemia), or multiple myeloma.

In a preferred embodiment of the binding molecule or the pharmaceutical composition for use according to the invention, or the method of treating, preventing or ameliorating cancer of the invention, or the use of the invention, the cancer is colorectal cancer (CRC), including metastatic CRC (mCRC), gastric cancer (GC), pancreatic cancer (PAC) or esophageal cancer. In a particularly preferred embodiment of the invention the cancer is mCRC.

Colorectal cancer (CRC) is a distinct malignant disease listed in ICD-10 and one of the leading causes of cancer morbidity and mortality worldwide. Approximately 25% of CRC patients present with overt metastasis and metastatic disease develops in 40-50% of newly diagnosed patients. Although recent improvements in chemotherapy have extended survival durations of metastatic CRC, most patients will succumb to their disease. Hence there is a great need for further therapeutic agents to treat this disease.

Approximately 30-50% of colorectal cancers are known to have a mutated (abnormal) KRAS gene. KRAS mutations frequently found in neoplasms include those at exon 2 (codons 12 and 13) and exon 3 (codon 61) and can be analysed from tumor biopsies. They include activating mutations that result in continual signal transduction, stimulating downstream signalling pathways involved in cell growth, proliferation, invasion, and metastasis. Thus, in one embodiment, the binding molecules of the present invention are for use in the treatment of a KRAS mutant colorectal cancer (i.e., patients with KRAS mutant tumours). In an alternative embodiment, the binding molecules of the present invention are for use in the treatment of a KRAS wild type colorectal cancer (i.e., patients with KRAS wildtype tumours).

Stomach cancer, also known as gastric cancer, is the third-leading cause of cancer-related death. While the incidence has been decreasing since the early 20th century due to improvements in food conservation, stomach cancer remains an indication with poor progonosis, as the majority of patients present with already advanced disease and therapy options are limited to surgery, chemotherapy, radiation and a limited amount of targeted therapy.

Pancreatic cancer (PAC) is a malignant disease causing >400.000 deaths per year worldwide. It is among the most-common causes of cancer-related death in industrialized countries.

Despite therapeutic interventions like surgery and chemotherapy, pancreatic adenocarcinoma, accounting for ~90% of all pancreatic cancer cases, typically has a very poor prognosis, with approx. 25% of people surviving one year and only 5% of patients surviving for five years.

Esophageal cancer is among the most frequently diagnosed cancer worldwide. Similar to pancreatic cancer, diagnosis is difficult and tends to happen in already advanced stages, leading to a very poor prognosis for this indication. As a consequence, it accounts for approximately 5% of cancer-related deaths, thus making it the sixth most common cancer-related death cause.

The incidence of the two main types of esophageal cancer, namely esophageal squamous-cell carcinoma (ESCC, 60-70% of cases) and esophageal adenocarcinoma (EAC, 20-23% of cases) varies greatly between different geographical areas, with ESCC being more common in the developing world, whereas EAC is predominant in industrialized countries. Current treatment options are largely limited to surgery and chemo- or radiotherapy. Only localized tumors are treated with curative intent, whereas therapy of metastatic disease is largely palliative.

A stated above the inventors have identified that the binding molecules described herein have much utility for targeting cancer cells and therefore can be used in the therapy of cancers which express both TROP2 and CDH17. Methods of identifying whether a particular tumor expresses TROP2 and CDH17 are well known in the art. For example immunohistochemistry can be used to determine whether tumor tissue expresses TROP2 and CDH17 (e.g. using the TROP2 and/or CDH17 antibodies as described herein) and hence would be suitable for treatment with the binding molecule of the invention.

The binding molecules of the invention may be used in therapeutic regimens in the context of first line, second line, or any further line treatments and maintenance treatment.

In a further aspect, a binding molecule of the invention is used in combination with a device useful for the administration of the binding molecule, such as a syringe, injector pen, micropump, or other device. In a further aspect, a binding molecule of the invention is comprised in a kit of parts, for example also including a package insert with instructions for the use of the binding molecule.

EXAMPLES

The invention is now described by way of the following non-limiting examples

Example 1: Identification of Trop2 and CDH17 as Membrane Proteins Co-Expressed on GI Cancer Tissue but not on Normal Tissue Gene expression of Trop2 and CDH17 in tumor and critical normal tissues obtained from GeneLogic was measured with the Affymetrix Chipset HGU133a and HGU133b and co-expression in tumor tissues of certain indications, such as gastric, pancreas, oesophagus and colorectal carcinoma was confirmed, as shown in FIG. 1. No co-expression was detected in normal tissues.

Figure 2:
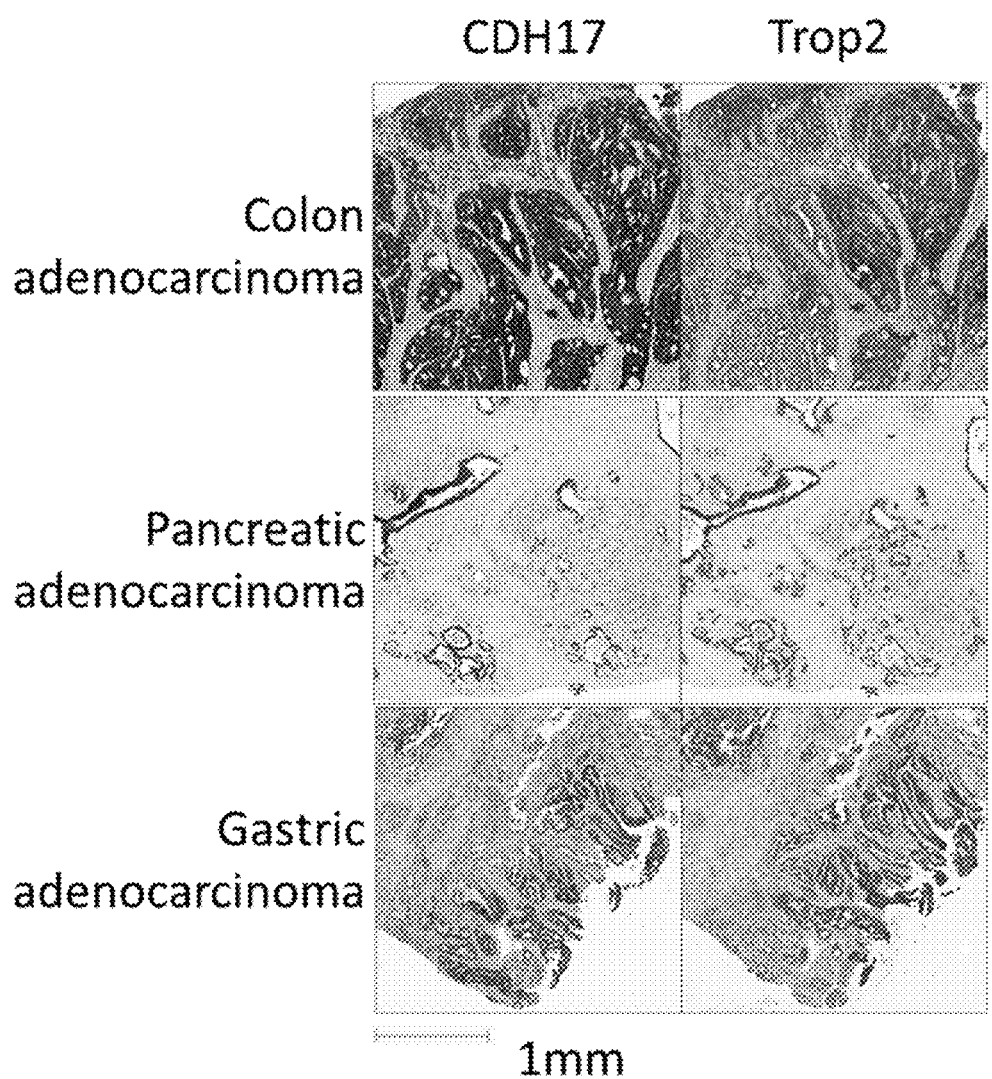
FIG. 2: Confirmation of target expression in GI tumors. Immunohistochemistry using antibodies binding to Trop2 (ENZ-ABS380, Enzo) and CDH17 (760-4865, Roche Ventana) on selected human cancer tissues.

The expression of CDH17 and Trop2 protein was further assessed in human tumor tissue sections by immunohistochemistry using antibodies binding to Trop2 (ENZ-ABS380, Enzo) and CDH17 (760-4865, Roche Ventana) in single staining and dual staining protocols. This additionally confirmed co-expression of these targets on tumor cells of gastric, pancreatic and colorectal origin (FIG. 2).

Example 2: Schematic Representation of a Trispecific Binding Protein of the Invention To achieve T-cell mediated lysis of tumor cells co-expressing Trop2 and CDH17, multi-specific binding proteins that bind Trop2, CDH17 and CD3 were designed. One exemplary molecular design used has an IgG antibody scaffold and an IgG-like structure, as shown in FIG. 3. It features the knob-in-hole technology in the Fc-domain for hetero-dimerization known in the art with the Knob-part on the anti-Trop2 binding arm and the Hole-part on the anti-CDH17 binding arm. In addition, the binding protein has flexible peptide sequences between the light and the corresponding heavy chain in each arm. A CD3-binding single-chain variable region is attached in this exemplary design to the Fc-portion of the hole chain. Thus, the binding protein comprises three antigen binding sites, one binding to Trop2, the other one binding to CDH17, wherein each arm comprises a single chain Fab and an Fc region, and a third antigen binding site binding to CD3 as an scFv. In a preferred molecular design, the binding molecule is tri-specific and tri-valent (i.e. monovalent respectively for each of the three targets).

Example 3: Design, Construction and Verification of Antigen Binding Sites and Tri-Specific Binding Molecules Example 3.1: Preparation of Antigen Binding Sites that Recognize Trop2 and CDH17 Using High Throughput V Gene Recovery from Hybridomas and Cultured Single B Cells To obtain anti-Trop2 binders, hybridomas or single B cells derived from Trop2 immunized wild-type and AlivaMab humanized mice (Ablexis, San Francisco, CA, USA: AlivaMab transgenic mouse platform with human immunoglobulin loci) were cultured in vitro. Supernatants were screened for reactivity against recombinant human Trop2, by AlphaLISA (PerkinElmer, Waltham, MA, USA), and binding to a primary cancer cell line expressing human Trop2 was confirmed by Flow Cytometry.

To obtain anti-CDH17 binders, immunization of wild-type mice was performed at Abpro (Abpro SOW #4). Hybridomas or single B cells derived from the immunized mice were cultured in vitro. Supernatants were screened for reactivity against recombinant human CDH17, by AlphaLISA (PerkinElmer, Waltham, MA, USA), and against cells of the AsPC-1 pancreatic tumor cell line (ATCC®, CRL-1682) and/or the NCI-H716 colon tumor cell line (ATCC®, CCL-251) expressing human CDH17, by Flow Cytometry. Lymph nodes were processed according to standard Abpro hybridoma procedure. Primary screening was performed by ELISA using hCDH17-His (prepared as described in Example 4.5 below). All ELISA-positive wells were screened by flow cytometry against the 2 cell lines listed above. All ELISA- and cell-line positive wells were expanded and re-tested by both methods. Affinity ranking of expanded positive hybridomas was done using the ForteBio Octet.

For both Trop2 and CDH17, Immunoglobulin (Ig) VH and VL genes were then amplified from identified positive clones. To isolate RNA from hybridomas, about $2 \times 10^6$ cells from single clones were pelleted and used as source material. For single B cells, 100 to 500 cells expanded from singularly isolated B cells were used as source material. RNA was isolated using RNeasy Plus (Qiagen, Hilden, Germany). cDNA was then synthesized using Smarter cDNA synthesis kit (Clontech, Mountain View, CA) according to manufacturer's instructions.

To facilitate cDNA synthesis, oligodT was used to prime reverse transcription of all messenger RNAs followed by "5' capping" with a Smarter IIA oligonucleotide. Subsequent amplification of the VH and VL fragments was performed using a 2-step PCR amplification using 5' primers targeting the Smarter IIA cap and 3' primers targeting consensus regions in CH1. Briefly, each 50 µl PCR reaction consists of 20 µM of forward and reverse primer mixes, 25 µl of PrimeStar Max DNA polymerase premix (Clontech), 2 µl of unpurified cDNA, and 21 µl of double-distilled H$_2$O. The cycling program starts at 94° C. for 3 min, followed by 35 cycles (94° C. for 30 Sec, 50° C. for 1 min, 68° C. for 1 min), and ends at 72° C. for 7 min. The second round PCR was performed with VL and VH 2nd round primers containing 15 bp complementary extensions that "overlap" respective regions in their respective pTT5 mother vector (VH and VL). Second round PCR was performed with the following program: 94° C. for 3 min; 35 cycles (94° C. for 30 Sec, 50° C. for 1 min, 68° C. for 1 min), and ends at 72° C. for 7 min.

In-Fusion® HD Cloning Kit (Clontech, U.S.A.) was used for directional cloning of VL gene into a pTT5 huIgK vector and VH gene into a pTT5 huIgG1KO vector. To facilitate In-Fusion® HD Cloning, PCR products were purified and treated with Cloning Enhancer before In-Fusion HD Cloning. Cloning and transformation were performed according to manufacturer's protocol (Clontech, U.S.A.). Mini-prep DNAs were subjected to Sanger sequencing to confirm that complete V-gene fragments were obtained.

Using this methodology, pairs of Ig VH and VL genes encoding antigen binding sites with specificity for Trop2 and CDH17 were prepared. Recombinant antibodies were produced by transient transfection of CHO-E37 cells with the corresponding heavy and light chain-encoding plasmids.

Example 3.2: Confirmatory Screening of Recombinant Antibodies

Supernatants containing expressed recombinant antibodies were assayed by flow cytometry for binding to cell lines expressing human or cynomolgus Trop2 and CDH17, respectively. Briefly, cells were incubated with recombinant supernatants, washed, and bound monoclonal antibodies (mAbs) from the supernatants were detected with anti-human-IgG-APC (Jackson ImmunoResearch 109-136-098). Signal-to-background ratios (S/B) were calculated by dividing the median fluorescence intensity (MFI) of the sample by that of isotype control (variable regions against an unrelated protein and different constant region backbones).

Surface Plasmon Resonance (SPR) on Biacore 4000 was performed on recombinant supernatants. Briefly, the non-optimized IgGs in the HTP supernatants were captured via Protein A/G onto the sensor surface for 60 sec at 10 µl/min. Binding of 100 nM human Trop2 or 100 nM human CDH17 to the captured IgGs was monitored for 180 sec of association at 30 µl/min, followed by 120 sec of dissociation in HBS-EP buffer. Regeneration of the Protein A/G surface was performed with Glycine pH 2.1 in between each binding cycle.

The following materials were used in this assay: Protein reagent: recombinantly expressed human Trop2 and CDH17. System running buffer: HBS-EP buffer (10 mM HEPES pH 7.4, 150 mM NaCl, 3 mM EDTA, and 0.005% v/v polysorbate P20). Capturing reagent: Protein A/G G (ThermoFisher Scientific, Waltham, MA, USA), with specificity towards all human IgG isotypes.

Clones of interest (with a Kd in the nM range) were selected for multispecific formatting. Multispecific binding proteins were subsequently generated and further evaluated in mechanistic and functional screening (such as e.g. cell binding, cytotoxicity and T cell activation) as described below.

Example 3.3: Humanization and Optimization of Trop2 and CDH17 Binders

Sequences of Trop2 and CDH17 binders as described above were humanized and/or optimized. Sequence optimization/humanization of antibodies is a methodology to engineer antibodies raised in non-human species (against a specific antigen/epitope) for use as therapeutics that resemble antibodies produced in humans and thereby eliminating potential adverse effects such as immunogenicity while retaining the specificity. The sequence optimization/humanization approach utilized here was as described by Singh et al, 2015 (Singh S et al., mAbs 2015: 7(4):778-91). In brief, closely matching human germlines were identified in silico, and optimization/humanization variants were evaluated using a phage screening method. Final lead candidate sequences were selected based on binding, percent human score and Epivax (in silico predictive tool for potential immunogenicity) score.

Example 3.4: scFv Conversion of CD3 Binders

To construct the gene segment encoding CD3 scFvs, pairs of VL and VH genes encoding CD3-binding variable domains were derived from the humanization of CD3 binders described in the literature (Pessano et al., EMBO J. 1985 February; 4(2): 337-44; Salmeron A et al., J Immunol. 1991 Nov. 1; 147(9):3047-52) and were joined by a gene segment encoding a flexible linker of the peptide sequence GGSEGKSSGSGSESKSTGGS (SEQ ID NO:265).

Example 3.5: Construction of Trispecific Proteins Binding Trop2, CDH17 and CD3 and Controls The variable regions of the Trop2, CDH17 binders and the CD3 scFv and the corresponding controls were cloned into the expression vector pTT5 (National Research Council, Canada), using common molecular biology techniques to form tri-specific binding proteins with one Trop2 specific binding unit comprising a single chain Fab binding to Trop2 and an Fc region (such binding unit also referred to herein as "Trop2 arm" or "Trop2 chain") and a CDH17 specific binding unit comprising a single chain Fab binding to CDH17 and an Fc region (such binding unit also referred to herein as "CDH17 arm" or "CDH17 chain), and the CD3 scFv appended to the C-terminus of one of the arms, preferably the CDH17 arm. A 20 amino acid spacer, was used to separate the scFv from the Fc. The Fc regions of the Trop2 and CDH17 arms include either "Knob" or "Hole" mutations (Atwell et al, JMB, 1997, 270, 26-35) and the respective chains are referred to as Knob or Hole chains. For multi-fragment DNA assembly, a Gibson-assembly and NEBuilder HiFi DNA assembly approach were used, following manufacturer's protocols (New England Biolabs, Ipswich, MA, USA). DNA mini-preps were sequenced.

Each expression vector contained eukaryotic promoter elements for the chain-encoding gene (Trop2 or CDH17 arm/chain), i.e., the gene encoding the signal sequence and the light and heavy chain, an expression cassette for a prokaryotic selection marker gene such as ampicillin, and an origin of replication. These DNA plasmids were propagated in ampicillin resistant E. coli colonies and cultures, and were purified.

Control molecules in various assemblies including Trop2/Trop2/CD3, CDH17/CDH17/CD3, Trop2/TNP/CD3, TNP/CDH17/CD3 and TNP/TNP/CD3 were cloned using Gibson-assembly and NEBuilder HiFi DNA assembly approach as described above and cloned into the pTT5 vector for transient expression.

Example 4: Expression and Purification of Trispecific, Trivalent Binding Proteins Binding Trop2, CDH17 and CD3

Trispecific molecules binding Trop2, CDH17 and CD3 as well as the corresponding controls were produced by transient transfection of CHO-E cells with the pTT5 vectors carrying the Trop2/CDH17/CD3-chain-encoding genes. Briefly, transfected CHO-E cells growing in suspension in serum-free media were cultivated in shake flasks under agitation at 140 rpm, 37° C. and 5% CO2 and kept at conditions of exponential growth. On the day of transfection, cells were chemically transfected with Knob-chain plasmid and Hole-chain plasmid in 1:3 mass ratio. They were then seeded at 1 to 2×10^6 cells/ml in 1 L of Gibco® FreeStyle™ CHO expression medium (LifeTechnologies, NY, US). Cells were then incubated under orbital shaking for 10 days with one-time feeding of 200 ml commercial feed solution to allow expression of the proteins. Antibody titers in the cell culture supernatants were determined using an Octet® instrument (Pall ForteBio, CA, US) and protA biosensor tips according to manufacturer's instructions.

Recombinant Trop2/CDH17/CD3 binding proteins were purified from culture supernatant in a two-step process: first by Protein A affinity chromatography using MabSelect™ column (GE Healthcare); second, by Cation exchange chromatography using a Poros 50 HS column (Applied Biosystems, Carlsbad, CA, USA). The two-step purified material was stored in final buffer of 50 mM Sodium Acetate and 100 mM NaCl, pH 5.0 Purity and degree of heterogeneity of the samples were assessed by analytical size-exclusion chromatography, mass spectrometry and analytical ultracentrifugation. Samples that were advanced for functional testing comprised two-step purified material, with >98% monomer content.

Example 4.1: Framework Engineering of Anti-Trop2 Antibodies to Reduce Isoelectric Point Imbalance The trispecific molecules containing anti-Trop2, anti-CDH17, and anti-CD3 were subsequently further modified to minimize the amount of aggregation observed (~65% Monomer after single-step ProA purification). In silico analysis of the individual Fv arms showed that the anti-Trop2 antibody had a pI that was 1 unit lower (pI=7.7) than the anti-CDH17 (pI=8.5) and anti-CD3 arms (pI=8.8). The hypothesis of this engineering strategy was that raising the pI of the anti-Trop2 arm to be more in line with the anti-CDH17 and anti-CD3 arms would decrease aggregation and increase monomer percent. The mutations were selected from a subset of residues that had either a Lysine or Arginine in framework positions in at least one naturally occurring heavy chain or Kappa light chain, irrespective of family. There were a total of 7 point mutations selected in the heavy chain (plus parental) and a total of 4 point mutations in the light chain (plus parental). Modelling of the charge variants showed that an incorporation of a single point mutation raised the pI of the anti-Trop2 Fv to an average of 8.3, and a double mutant (one on the heavy, one on the light) would raise the pI to 8.8.

The following mutations were selected as suitable to raise the pI of the anti-Trop2 Fv: VH: S19K, T23K, G43R, S61K, T72R, S83R, T85R and VL: Q3R, S65K, S76R, Q79K. The numbering is based on the Kabat numbering scheme and the first amino acid of the VH or VL domain, respectively, counts as number 1 (i.e. the mutation S19K is a mutation in the 19th amino acid of the VH domain, etc.).

Example 4.2: Optimization of Anti-CD3 scFv for Improved Stability

In order to increase the stability of the anti-CD3 scFv, a structural modeling based approach was used. Molecular models for the Fv portions of CD3 #1(SEQ ID NO:222) were created via high throughput antibody modeling enabled by Antibody Modeler in MOE (Chemical Computing Group, ULC). The structural model was used to compute descriptors for VL and VH interface stability in the Fv regions as well as their solution and molecular surfaces. Positions determined to impact biophysical properties in silico were identified and a library of variants was generated and screened for improved serum stability in the trispecific format. Eight mutations in the light chain (R23G, E40O, L45A, G59W, V60T, L77I, E87D and F89Y) and 9 mutations in the heavy chain (K19R, S30N, G49A, D68G, T80S, A81 L, N87S, K89R and T90A) were identified that impacted the biophysical properties either individually (see e.g. in CD3 #8, SEQ ID No:229) or in combination (see e.g. in CD3 #2 (SEQ ID NO:223), 3 (SEQ ID NO:224), 5 (SEQ ID NO:226), 7 (SEQ ID NO:228)). Again, the numbering is based on the Kabat numbering scheme and the first amino acid of the VH or VL domain, respectively, counts as number 1 (i.e. the mutation R23G is a mutation in the 23rd amino acid of the VL domain, etc.).

Example 4.3: Percent Monomer Content of Trop2/CDH17/CD3 Binding Proteins

Percent monomer was determined for exemplary Trop2/CDH17/CD3 binding proteins by Analytical Size Exclusion Chromatography (aSEC) as shown in Table 2. aSEC was run on a Waters (Milfrod, MA, USA) Acquity UPLC system using a Protein BEH SEC column 200 Å, 1.7 µm, 4.6×150 mm (Cat #186005225). Running conditions were as follows: Mobile phase: 50 mM Sodium Phosphate, 200 mM Arginine and 0.05% Sodium Azide; Flow rate: 0.5 ml/min; Runtime: 5 minutes; Sample loading amount: 10 µg; Peak detection: A280 nm; Automated processing method of chromatograms.

TABLE 2

Percent monomer after first and second purification step for trispecific molecules containing Trop2, CDH17 and CD3. The sequences of the respective binders can be found in Table 1.

| Trop2 | CDH17 | CD3 | Percentage Monomer after 1st step of purification | Percentage Monomer after 2nd step of purification |
|---|---|---|---|---|
| Trop2 | CDH17 | CD3 | (Prot. A) | (CEX) |
| Trop2#8 | CDH17#1 | CD3#1 | 86.16 | >98% |
| Trop2#9 | CDH17#1 | CD3#1 | 62.07 | >98% |
| Trop2#10 | CDH17#1 | CD3#1 | 80.58 | >98% |
| Trop2#11 | CDH17#1 | CD3#1 | 84.13 | >98% |
| T rop2#5 | CDH17#1 | CD3#1 | 76.27 | >98% |

TABLE 2-continued

Percent monomer after first and second purification step for trispecific molecules containing Trop2, CDH17 and CD3. The sequences of the respective binders can be found in Table 1.

| | | | Percentage Monomer after 1st step of purification | Percentage Monomer after 2nd step of purification |
|---|---|---|---|---|
| Trop2#7 | CDH17#1 | CD3#1 | 86.37 | >98% |
| Trop2#12 | CDH17#8 | CD3#9 | 73.92 | >98% |
| Trop2#12 | CDH17#8 | CD3#10 | 55.96 | >98% |
| Trop2#12 | CDH17#8 | CD3#2 | 64.81 | >98% |
| Trop2#12 | CDH17#8 | CD3#7 | 73.68 | >98% |
| Trop2#12 | CDH17#8 | CD3#3 | 61.68 | >98% |
| Trop2#12 | CDH17#8 | CD3#8 | 60.63 | >98% |
| Trop2#13 | CDH17#8 | CD3#2 | 75.8 | >98% |
| Trop2#14 | CDH17#8 | CD3#2 | 85 | >98% |
| Trop2#15 | CDH17#8 | CD3#2 | 77.32 | >98% |
| Trop2#16 | CDH17#8 | CD3#2 | 74.21 | >98% |
| Trop2#17 | CDH17#8 | CD3#3 | 74.06 | >98% |
| Trop2#14 | CDH17#8 | CD3#3 | 74.8 | >98% |
| Trop2#18 | CDH17#8 | CD3#3 | 73.32 | >98% |
| Trop2#15 | CDH17#8 | CD3#3 | 76.28 | >98% |

Example 4.4: Thermostability

Thermostability was determined by Thermal Shift Analysis (TSA) and results of the first melting transitions (Tm1) of representative Trop2/CDH17/CD3 binding proteins are shown in Table 3. The fluorescence intensity profile as a function of temperature was acquired using a QuantStudio 6 Flex real-time PCR system (Applied Biosystems, Waltham, MA) with SYPRO Orange (Invitrogen, Carlsbad, CA) as the extrinsic fluorophore. Sample was diluted to 0.4 mg/ml in 10 mM histidine, pH 6.0 with 40 mM sodium chloride and 0.02% sodium azide. The melt curve was generated with a thermal ramp from 25° C. to 95° C. at a rate of 2° C./min, with data collected approximately every 0.4° C. through the 'ROX' filter set (Ex: 580±10 nm, Em: 623±14 nm). Data were analyzed using Protein Thermal Shift Software Version 1.3 (ThermoFisher Scientific, Waltham, MA).

TABLE 3

Thermostability measured by the first melting transitions (Tm1) of representative Trop2/CDH17/CD3 binding proteins.

| Trop2# | CDH17# | CD3# | Tm 1 (° C.) |
|---|---|---|---|
| T rop2#5 | CDH17#1 | CD3#1 | 59.5 |
| Trop2#7 | CDH17#1 | CD3#1 | 59.3 |
| Trop2#8 | CDH17#1 | CD3#1 | 59.1 |
| Trop2#9 | CDH17#1 | CD3#1 | 58.6 |
| Trop2#10 | CDH17#1 | CD3#1 | 59.7 |
| Trop2#11 | CDH17#1 | CD3#1 | 59.9 |
| Trop2#12 | CDH17#8 | CD3#9 | 58.3 |
| Trop2#12 | CDH17#8 | CD3#10 | 61.5 |
| Trop2#12 | CDH17#8 | CD3#2 | 61.8 |
| Trop2#12 | CDH17#8 | CD3#7 | 57.6 |
| Trop2#12 | CDH17#8 | CD3#3 | 58.8 |
| Trop2#12 | CDH17#8 | CD3#8 | 56.6 |
| Trop2#13 | CDH17#8 | CD3#2 | 62.5 |
| Trop2#14 | CDH17#8 | CD3#2 | 64.4 |
| Trop2#14 | CDH17#8 | CD3#3 | 59.3 |
| Trop2#15 | CDH17#8 | CD3#2 | 62.1 |
| Trop2#15 | CDH17#8 | CD3#3 | 59.2 |
| Trop2#16 | CDH17#8 | CD3#2 | 64.6 |
| Trop2#17 | CDH17#8 | CD3#3 | 58.9 |
| Trop2#18 | CDH17#8 | CD3#3 | 59.1 |

Example 4.5: Production of Recombinant Proteins

Human Trop2-His and Human CDH17-His

A cell line to produce Human Trop2-His and human CDH17-His was generated using HEK-293 cells (Thermo Fisher), the Lenti-X Lentiviral System (Clontech), and plasmid encoding Human Trop2-His (human Trop2 Accession No. P09758) and Human CDH17-His (human CDH17 Accession No. Q12864). For expression, cells were cultured and expanded at 37 C, 5% CO2, and shaking at 140 rpm. On Day 0 of expression, cell were pelleted and re-suspended in Expi 293 media. On day 3 of expression the conditioned culture supernatant was harvested by pelleting the cells for 40 minutes at 4700 rpm. Protease inhibitors were added to the biomass before purification. Expression was confirmed by western blot. The conditioned culture supernatant was adjusted with 0.5 mM TCEP, 0.02% CHAPS, 10 mM imidazole. Purification was carried out on a HisTrap Ni excel column and Buffer A: 50 mM MES, 50 mM NaCl, 0.5 mM TCEP, 0.02% CHAPS, pH 6.5. The protein of interest was eluted in Buffer A supplemented with 0.5M Imidazole, pH 8.5, using an elution gradient from 20 mM imidazole to 500 mM imidazole. The pooled fractions were dialyzed in buffer: 50 mM MES, 50 mM NaCl, 1 mM TCEP, 0.02% CHAPS, 0.2M Arginine, 3% glycerol, pH 6.5. The purified material was qualified by mass spectrometry and analytical ultra-centrifugation.

Cyno Trop2-His and Cyno CDH17-His

Cell lines to produce Cyno Trop2-His and Cyno CDH17-His were generated using HEK-293 cells (Thermo Fisher), the Lenti-X Lentiviral System (Clontech), and plasmid encoding Cyno Trop2-His (Cyno Trop2 Accession No: Accession #XP_001114599.1 (RefSeq)) and Cyno CDH17-His (Cyno CDH17 Accession No: XP_005563762.1 (RefSeq)). For expression, cells were cultured and expanded at 37° C., 5% CO2, and shaking at 140 rpm. On Day 0 of expression, cells were pelleted and re-suspended in Expi 293 media. On day 3 of expression the conditioned culture supernatant was harvested by pelleting the cells for 40 minutes at 4700 rpm. Protease inhibitors were added to the biomass before purification. Expression was confirmed by western blot. The conditioned culture supernatant was adjusted with 0.5 mM TCEP, 0.02% CHAPS, 10 mM imidazole. Purification was carried out on a HisTrap Ni excel column and Buffer A: 50 mM MES, 50 mM NaCl, 0.5 mM TCEP, 0.02% CHAPS, pH 6.5. The protein of interest was eluted in Buffer A supplemented with 0.5M Imidazole, pH 8.5, using an elution gradient from 20 mM imidazole to 500 mM imidazole. The pooled fractions were dialyzed in buffer: 50 mM MES, 50 mM NaCl, 1 mM TCEP, 0.02% CHAPS, 0.2M Arginine, 3% glycerol, pH 6.5. The purified material was qualified by mass spectrometry and analytical ultra-centrifugation.

Example 5: Cell Line Generation for Binder Selection

For the generation of stable HEK293 cells expressing full-length human CDH17, either alone or in combination with Trop2, the coding sequence of CDH17 (Protein Accession 012864) was cloned into pCMV6 (Origene). For the generation of stable HEK293 cells expressing full-length human Trop2, either alone or in combination with CDH17, pCMV6 comprising the coding sequence of Trop2 with a C-terminal Myc-DDK-tag was obtained from Origene (#RC202519). HEK293 cells were transfected using Cell Line Nucleofector Kit V (Amaxa) according to manufacturer's instructions and stable clones were established using geneticin and puromycin selection, respectively.

The expression of the recombinant proteins was verified by flow cytometry using anti-Trop2 (R&D #MAB650) and anti-CDH17 (R&D #MAB1032) primary antibodies, followed by PE-labeled anti-mouse secondary antibody (Dako #R0480).

Example 6: Selection of CDH17 Binders with Avidity Potential and Confirmation of the Avidity Potential in Trispecific Format Binding of four different CDH17 binding proteins (i.e. CDH17 #6, CDH17 #4, CDH17 #7 and CDH17 #1; all produced as described in Example 3; the sequences of the respective binders can be found in Table 1) in either bivalent and monovalent format was tested. To this end, their binding to HEK293 cell lines recombinantly expressing human CDH17 prepared as described in Example 5 was analysed by flow cytometry.

Figure 4:
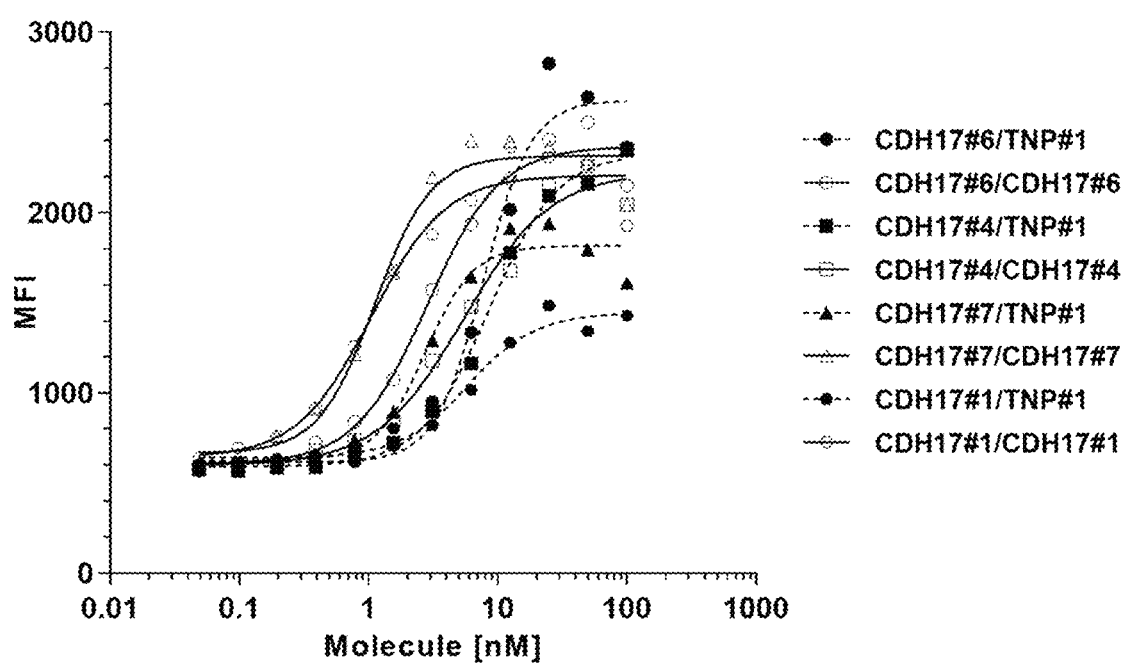
FIG. 4: Selection of CDH17 binders with avidity potential. Binding of the shown four different CDH17 binding proteins (either in bivalent and monovalent format) to a HEK293 cell line recombinantly expressing human CDH17 as tested by flow cytometry. The anti-TNP binding arm is an irrelevant (non-binding) control directed against tetra-nitro-phenol.

The HEK293 cells were stained with increasing concentrations of two-step purified bivalent or monovalent CDH17 binding proteins in FACS buffer (PBS/0.5% BSA/0.05% sodium azide). Bound molecules were detected with FITC-conjugated anti-human secondary antibody (Invitrogen 05-4211). The avidity-potential of each CDH17 binding protein was assessed by comparing the binding curve of the respective monovalent format with the bivalent format (FIG. 4). Binding proteins showing a significant affinity shift from monovalent to bivalent format were selected for the subsequent experiments.

To further test the potential of these CDH17 binders to activate T cells, various CDH17 binders were assembled into trispecific Trop2/CDH17/CD3 binding molecules and T cell activation was assessed in the presence of Hek293 cells expressing either CDH17 alone, or a combination of CDH17 and Trop2. In this assay, Trop2/CDH17 positive cell lines were co-cultured with human T cells as effector cells and increasing concentrations of Trop2/CDH17/CD3 binding molecules for 72 hours at an effector to target cell ratio of 10:1. Trop2/CDH17/CD3 binding molecules were produced by transient transfection of CHO-E cells with the pTT5 vectors carrying the chain-encoding genes, as described in Example 4.

Frozen human peripheral blood mononuclear cells (PBMCs) were obtained from Stemcell Technologies. Cells were washed and resuspended in assay medium containing RPMI-1640 w/o Phenolred (Gibco/Lonza #BE 12-918-F) 5% HiFBS (FBS, HyClone (Thermo Scientific, Cat: SH30071.03), heat inactivated, 56° C., 30 min), Glutamax (Gibco #35050-061), 27.5 µM beta-Mercaptoethanol (Gibco #21985-023). T-cells were isolated from the washed PBMCs by negative selection using the Pan T Cell Isolation Kit II (Miltenyi Biotec #130-091-156). In brief, peripheral blood mononuclear cells were resuspend in 40 µl buffer PBS/0.5% BSA (Gibco ref #041-94553 M)/2 mM EDTA (Invitrogen ref #15575-038) per 10 Mio cells and incubated with 10 µl of Biotin-Antibody cocktail per 10 Mio cells for 5 min at 4° C. Subsequently, 30 µl buffer and 20 µl anti-biotin Micro-Beds/10 million cells were added and incubated for 10 min at 4° C. Subsequently the mixture was placed in a pre-rinsed 25LS column (Miltenyi Biotec #130-042-401) in the magnetic field of a suitable MACS separator (Miltenyi Biotec). Flow-through comprising the T cells was collected and washed in assay medium.

Subsequently, target cells and T cells at a ratio of 1:10 were incubated with Trop2/CDH17/CD3 binding proteins at the indicated concentrations (see FIG. 5) for 72 hours.

Figure 5:
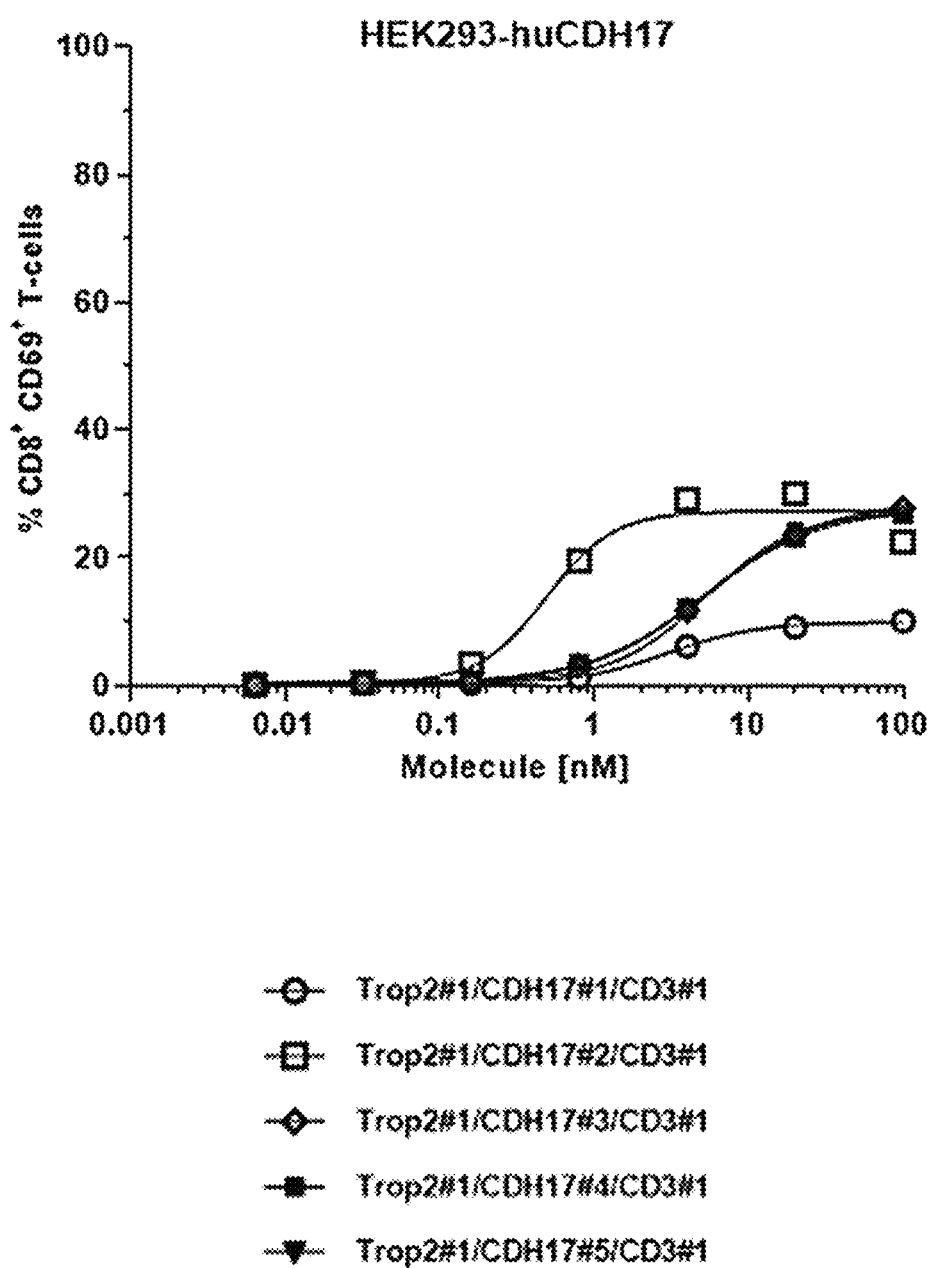
FIG. 5: Confirmation of avidity potential of CDH17 binders in trispecific format. Upregulation of the T cell activation marker CD69 on CD8+ T cells mediated by Trop2/CDH17/CD3 molecules with different CDH17-antigen binding sites in the presence of HEK293 cells either expressing only CDH17 (left panel) or co-expressing Trop2/CDH17 (right panel).
Figure 5:
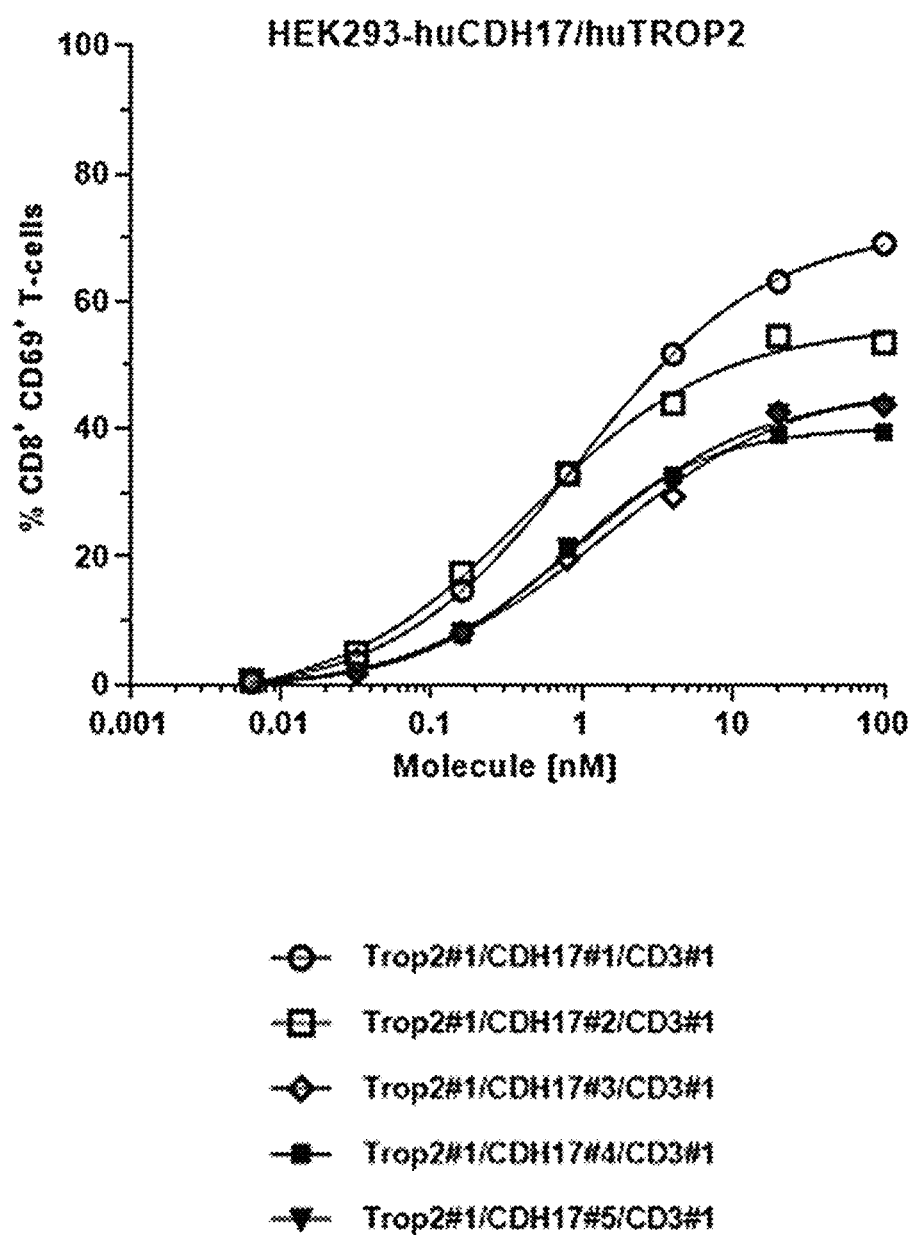

To determine T cell activation, cells were centrifuged and stained with antibodies against CD4 (Biolegend #31744), CD8 (BD #562428), and CD69 (BD #557745) and fluorescence was measured by flow cytometry. The results are depicted in FIG. 5.

The avidity potential was analysed by comparing the amount of CD8+ T cell activation induced in the presence of HEK293 cells either expressing only human CDH17 (FIG. 5A) or expressing a combination of CDH17 and Trop2 (FIG. 5B). Only binders causing less than 20% T cell activation at 100 nM in the presence of HEK293 cells expressing only CDH17 were selected for further evaluation.

Example 7: Selection of Trop2 Binders with Avidity Potential and Confirmation of the Avidity Potential in Trispecific Format Binding of seven different Trop2 binders (Trop2 #1 to Trop2 #7; the sequences of the respective binders can be found in Table 1) in either bivalent (IgG) or monovalent (knob-in-hole format with dummy binding arm) form was tested. In the monovalent format, one of the binding sites was replaced by a binding site binding to tetra-nitro-phenol (TNP; including the VH and VL domains of SEQ ID Nos:167 and 168), an irrelevant antigen not present in a eukaryotic context. To this end, their binding to HEK293 cell lines recombinantly expressing human Trop2 prepared as described in Example 5 was analysed by flow cytometry. Trop2 binding proteins were produced as described in Example 4.

Figure 6:
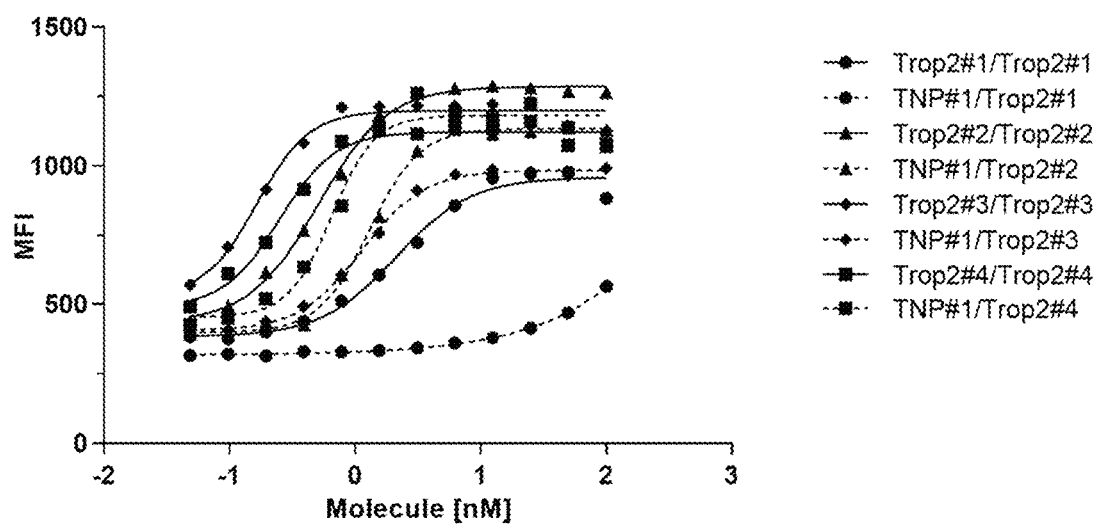
FIG. 6: Selection of Trop2 binders with avidity potential. Binding of the shown seven different Trop2 binders (either in bivalent or monovalent format) to a HEK293 cell line recombinantly expressing human Trop2 as tested by flow cytometry. The anti-TNP binding arm is an irrelevant (non-binding) control directed against tetra-nitrophenol.
Figure 6:
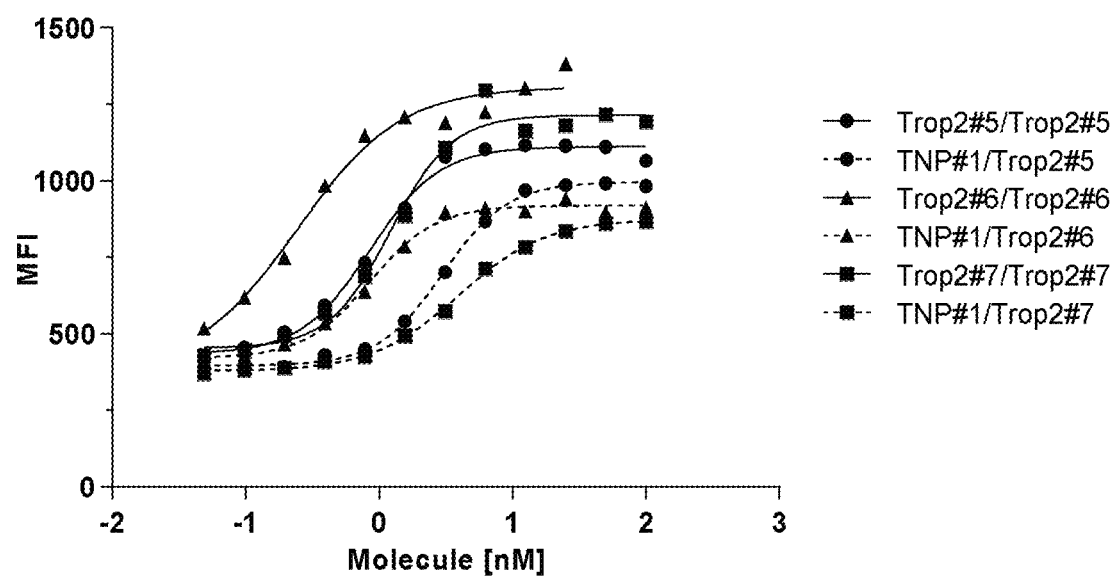

The HEK293 cells were stained with increasing concentrations of two-step purified bivalent or monovalent Trop2 binding proteins in FACS buffer (PBS/0.5% BSA/0.05% sodium azide). Bound molecules were detected with FITC-conjugated anti-human secondary antibody (Invitrogen 05-4211). The avidity-potential of each Trop2 binding protein was assessed by comparing the binding curve of the respective monovalent format with the bivalent format (FIG. 6). Binding proteins showing a significant affinity shift from monovalent to bivalent format were selected for the following experiments.

To further test the potential of these Trop2 binders to activate T cells, various Trop2 binders were assembled into trispecific Trop2/CDH17/CD3 binding molecules and T cell activation was assessed in the presence of Hek293 cells expressing either CDH17 alone, Trop2 alone, or a combination of CDH17 and Trop2. In this assay, Trop2/CDH17 positive HEK293 cell lines were co-cultured with human T cells as effector cells and increasing concentrations of Trop2/CDH17/CD3 binding molecules for 72 hours at an effector to target cell ratio of 10:1. Three different Trop2 binders with varying antigen affinity were combined in a trispecific format with the CDH17 binder identified in Example 6 (FIG. 5A) to induce the lowest T cell activation in the presence of HEK293 cells expression only CDH17. Trop2/CDH17/CD3 binding molecules were produced by transient transfection of CHO-E cells with the pTT5 vectors carrying the chain-encoding genes, as described in Example 4. Human T cells were isolated as described in Example 6.

Figure 7:
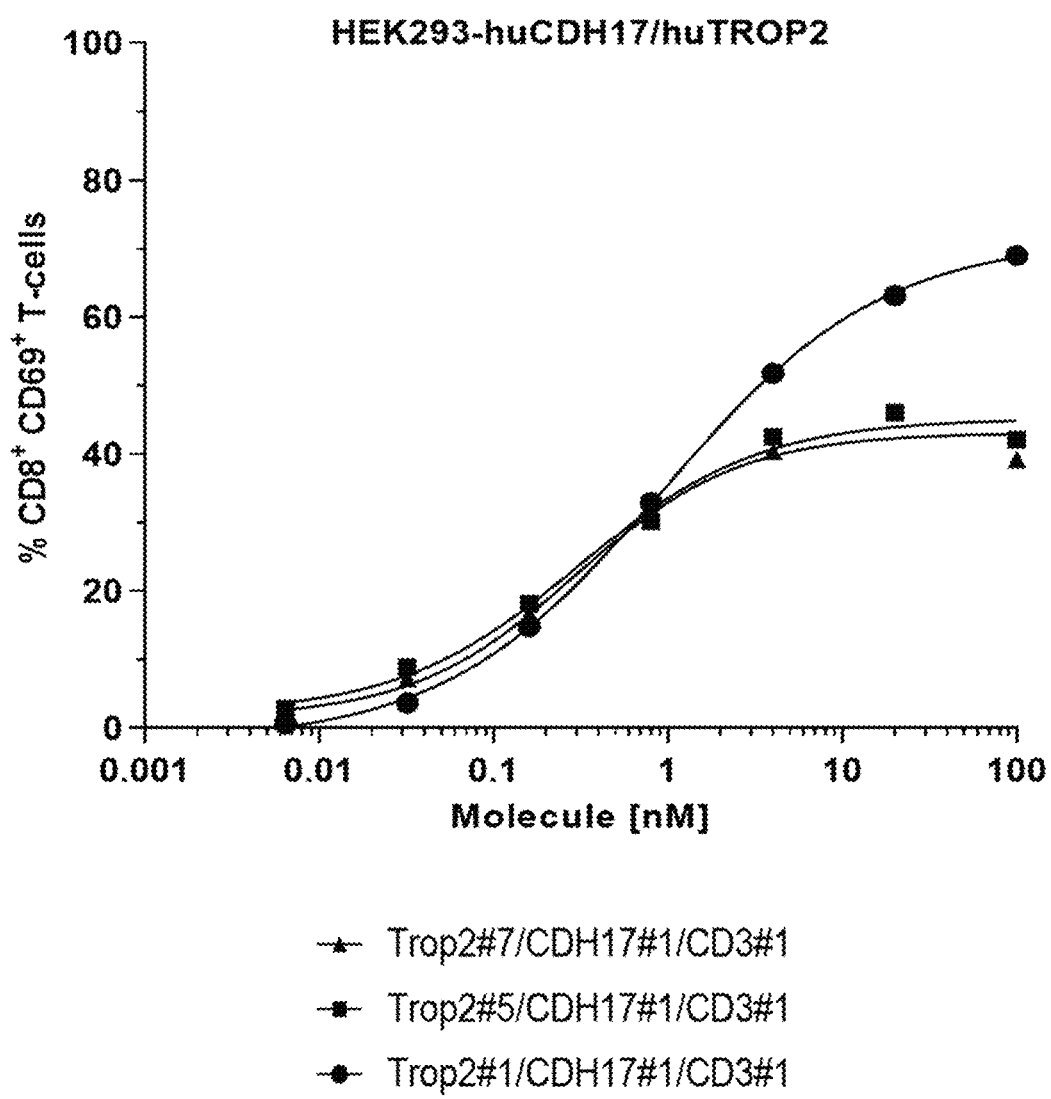
FIG. 7: Confirmation of avidity potential of Trop2 binders in trispecific format. Upregulation of the T cell activation marker CD69 on CD8+ T cells mediated by Trop2/CDH17/CD3 molecules with different CDH17-antigen binding sites in the presence of HEK293 cells either expressing only CDH17 (C), only Trop2 (B), or co-expressing Trop2/CDH17 (A).
Figure 7:
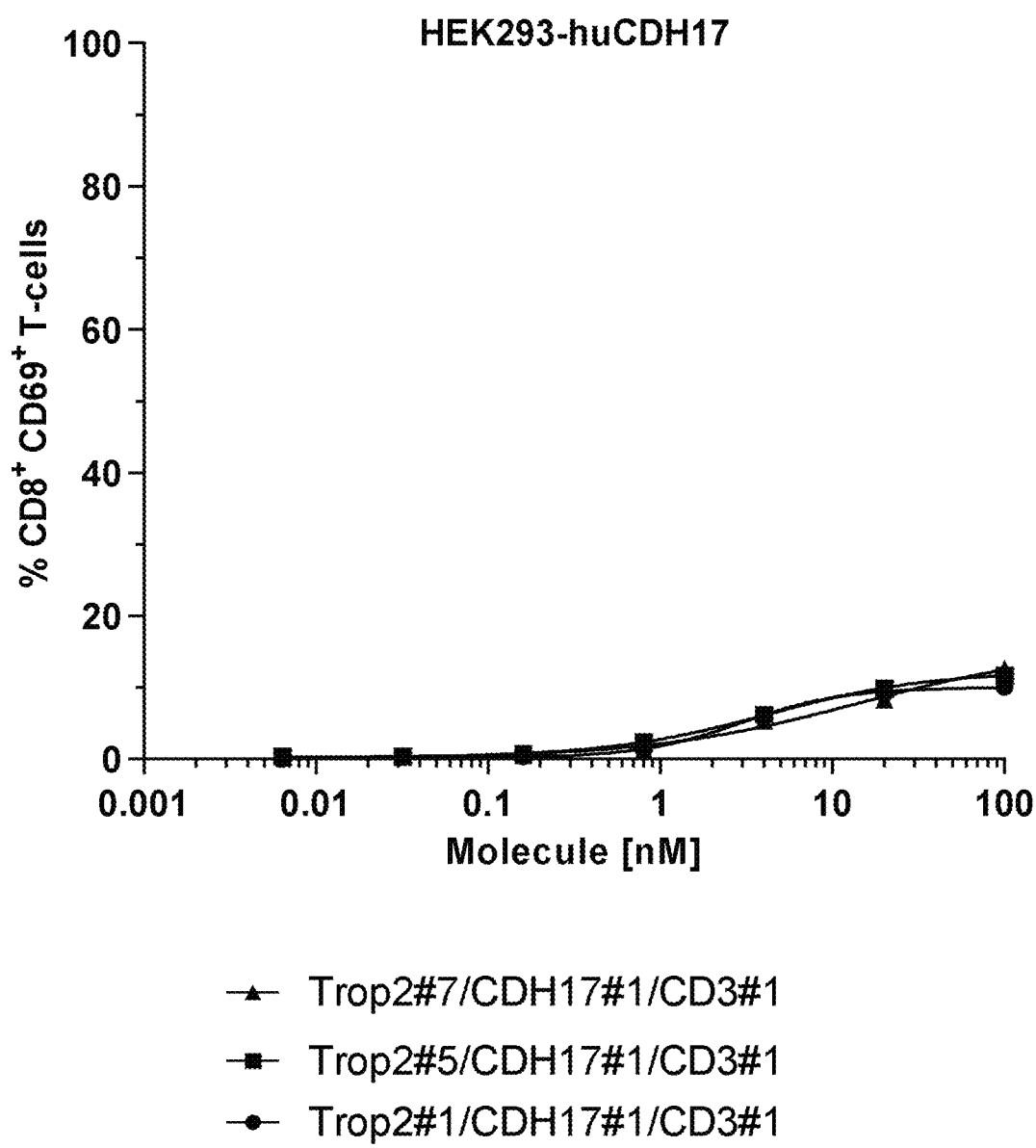
Figure 7:
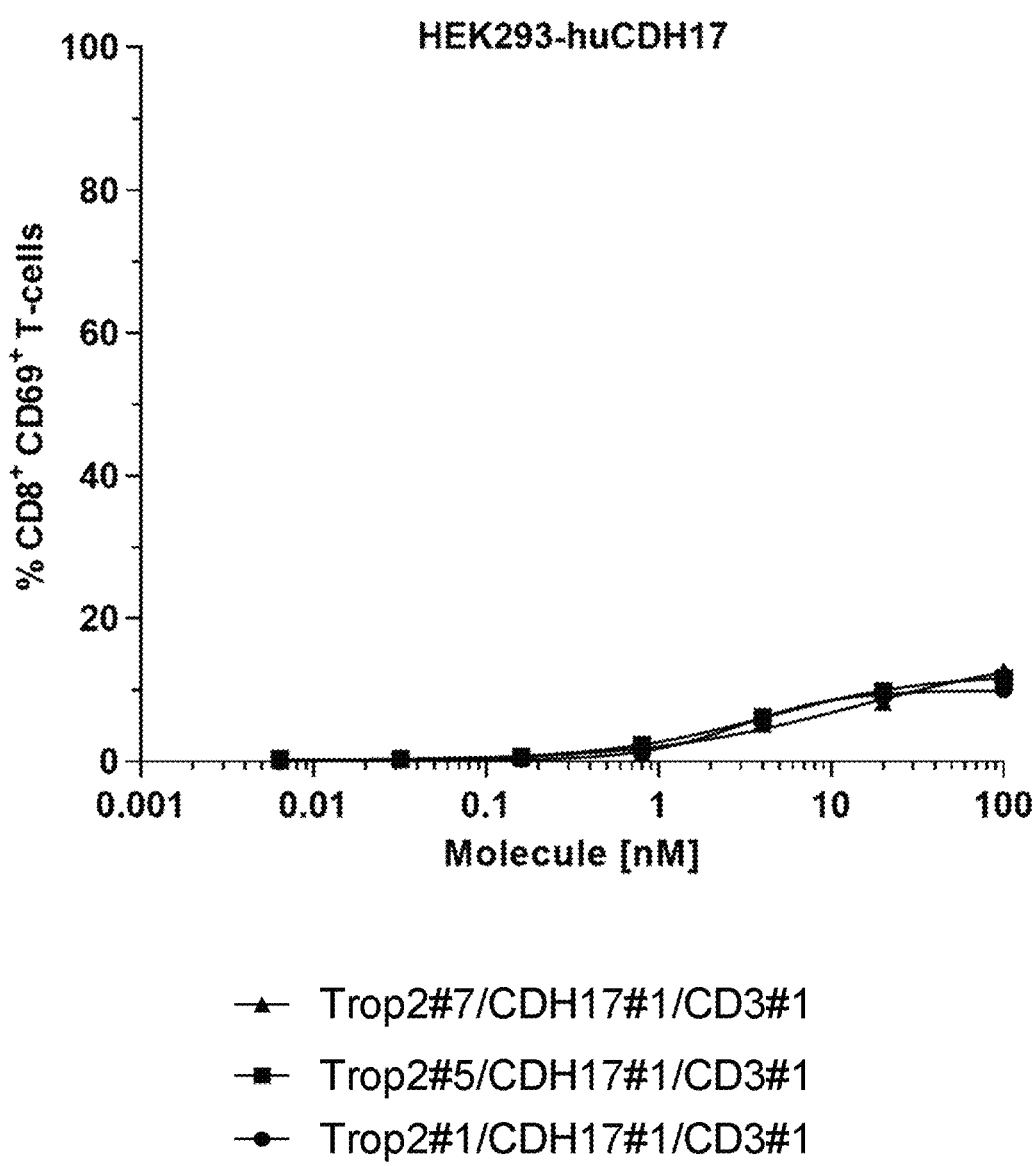

Subsequently, target cells and T cells at a ratio of 1:10 were incubated with Trop2/CDH17/CD3 binding molecules at the indicated concentrations (see FIG. 7) for 72 hours.

T cell activation status was determined as described in Example 6.

The avidity potential was analysed by comparing the amount of CD69 upregulation on CD8+ T cells induced in the presence of HEK293 cells expressing either only human Trop2 (FIG. 7B), only human CDH17 (FIG. 7C), or a combination of human CDH17 and human Trop2 (FIG. 7A). Again, binders causing less than 20% T cell activation at 10 nM in a monovalent binding context, i.e. on CDH17 (only)—or Trop2 (only)-expressing cells, were selected for the subsequent experiments.

The binding affinities to Trop2 expressed on HEK293 cells were assessed by the flow cytometry based Scatchard method and revealed a Kd of 2.2 nM for Trop2 #1, 0.6 for Trop2 #5 and 0.4 for Trop2 #7. The avidity potential inversely correlated with the affinity determined through this method, indicating that only low affinity binders allow for the discrimination of single-positive from double-positive cells in the bivalent format.

Example 8: Analysis of the Avidity Potential of Various Trispecific Trop2/CDH17/CD3 Binder Combinations in Cell Binding Assays In order to confirm the avidity-based potency increase, the target binding of three different Trop2/CDH17/CD3 trispecific binding molecules (Trop2 #1/CDH17 #1/CD3 #1 Trop2 #5/CDH17 #1/CD3 #1, Trop2 #7/CDH17 #1/CD3 #1, see FIG. 8) was compared with the binding of a bispecific Trop2/Trop2/CD3 binding molecule as well as a trispecific Trop2/TNP/CD3 binding molecule. To this end, binding of these molecules to a HEK293 cell line recombinantly expressing either human Trop2 (FIG. 8A), or co-expressing human Trop2 and human CDH17 (FIG. 8B), was tested by flow cytometry. Trop2/CDH17/CD3 Trop2/TNP/CD3 and Trop2/Trop2/CD3 binding proteins were produced as described in Example 4.

Figure 8:
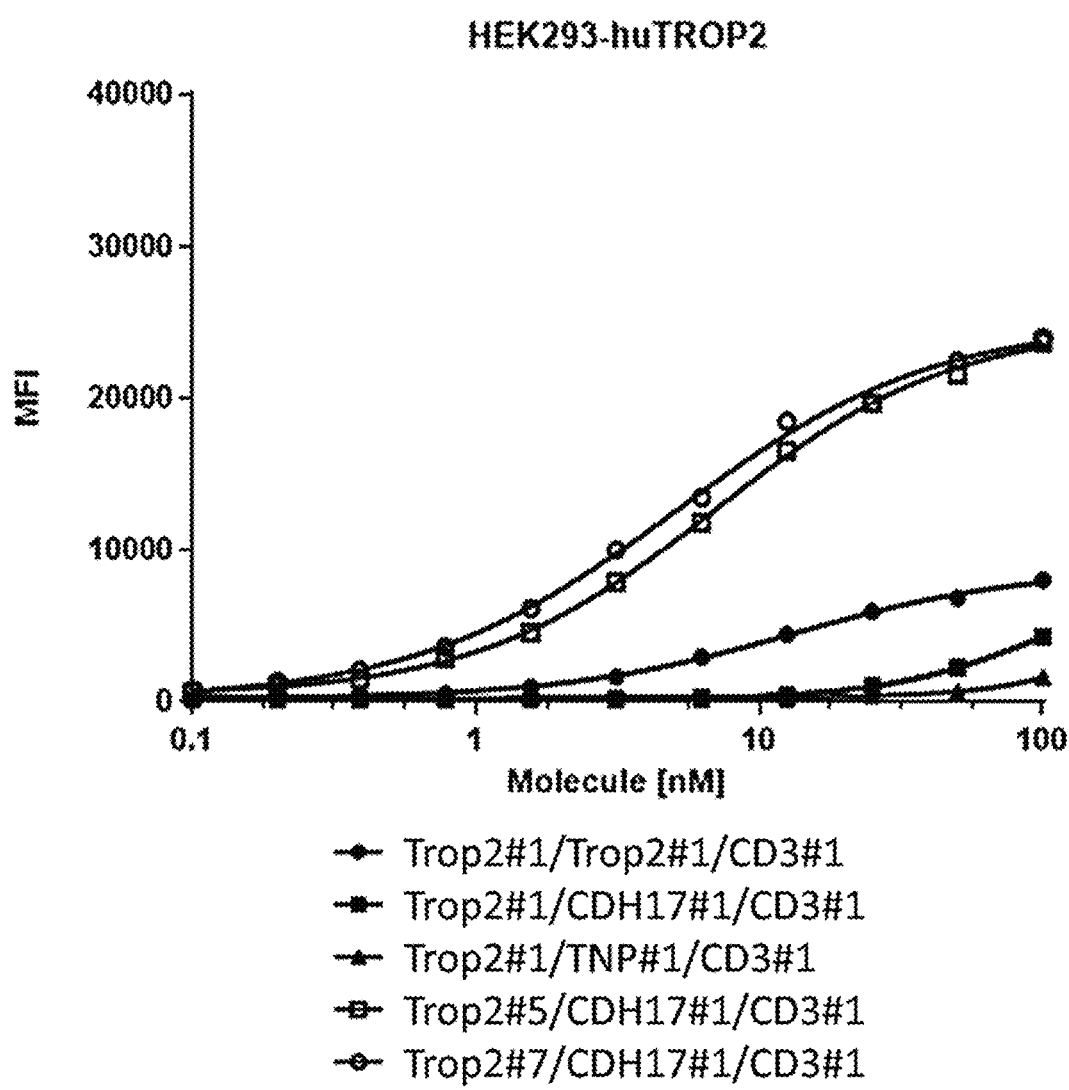
FIG. 8: Analysis of the avidity potential of various trispecific Trop2/CDH17/CD3 binder combinations in cell binding assays. Binding of different combinations of Trop2 and CDH17 binders in a trispecific format to a HEK293 cell line recombinantly expressing human Trop2 (A) or co-expressing human Trop2 and CDH17 (B) as tested by flow cytometry. The anti-TNP binding arm is an irrelevant (non-binding) control directed against tetra-nitrophenol.
Figure 8:
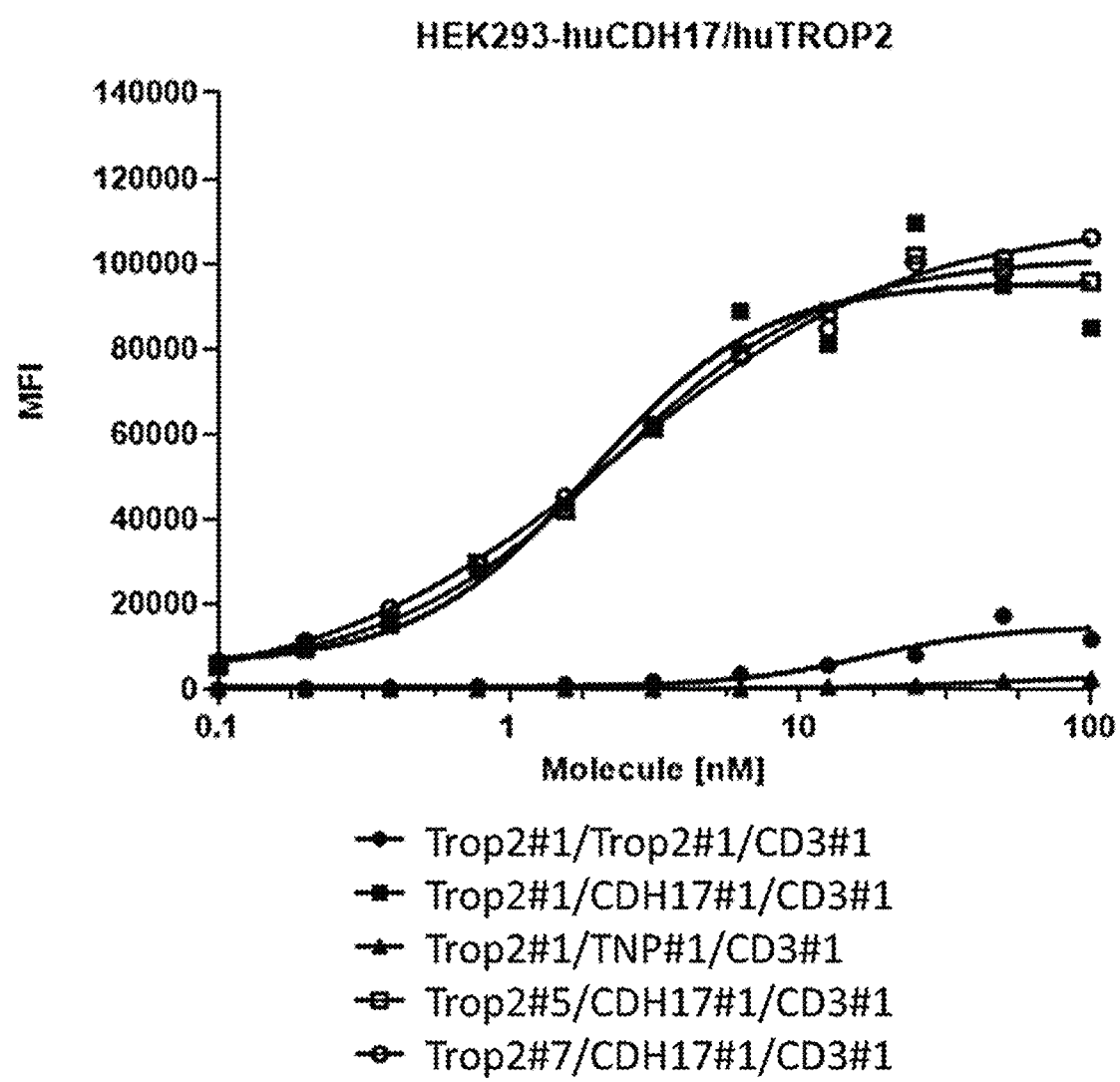

The HEK293 cells recombinantly expressing either human Trop2, or co-expressing human Trop2 and human CDH17, were stained with increasing concentrations of two-step purified Trop2/CDH17/CD3, Trop2/Trop2/CD3 and Trop2/TNP/CD3 binding molecules in FACS buffer (PBS/0.5% BSA/0.05% sodium azide). Bound molecules were detected with FITC-conjugated anti-human secondary antibody (Invitrogen 05-4211). The avidity-potential of each trispecific binding molecule was assessed by comparing the monovalent and bivalent binding curve. Binding proteins showing a significant binding to Trop2 alone were not selected for the avidity optimized bispecific binding approach. The results are shown in FIG. 8. The sequences of the respective binders can be found in Table 1.

Example 9: Potency in Mediating T Cell Induced Lysis in Cells Expressing CDH17, Trop2 or Co-Expressing Both To address the selectivity of Trop2/CDH17/CD3 binding proteins for human cells co-expressing both Trop2 and CDH17 proteins, the ability to induce lysis by redirecting non-stimulated T cells towards cells expressing human CDH17 and/or human Trop2 was tested.

The potency of T cell-mediated lysis of Trop2/CDH17 positive cell lines was determined using lactate-dehydrogenase (LDH) release as readout for cell lysis as described below. In this assay, cell lines expressing either Trop2 or CDH17 or both were co-cultured with human T cells as effector cells and increasing concentrations of Trop2/CDH17/CD3 binding molecules for 72 hours at an effector to target cell ratio of 10:1. Trop2/CDH17/CD3 binding molecules were produced by transient transfection of CHO-E cells with the pTT5 vectors carrying the chain-encoding genes, as described in Example 4.

Human T cells were isolated from frozen PBMCs as described in Example 6.

Cytotoxic activity was determined using the Cytotoxicity Detection Kit$^{PLUS}$ (Roche), following the manufacturer's instructions. In brief, this method is based on the release of LDH from dead or plasma-membrane damaged cells. Cell culture supernatant is incubated with the reaction mixture from the kit for 30 minutes and the formation of Formazan, as a result of LDH activity, is measured in a spectrophotometer at 500 nm as surrogate for cell lysis. Percentage of cytotoxicity relative to the maximal lysis control was calculated according to the following formula:

$$\text{Cytotoxicity (relative to control)} = \frac{\text{measured value} - \text{background}}{\text{maximal lysis} - \text{minimal lysis}}$$

Background: Target cells+Effector cells
Maximal lysis: Target cells+5% Triton X-100
Minimal lysis: Target cells Using GraphPad Prism 5 software, the percentage of cytotoxicity relative to the maximal lysis control was plotted against the corresponding Trop2/CDH17/CD3 binding molecule concentrations. Dose response curves were analysed with the four-parameter logistic equation model for evaluation of sigmoidal dose-response curve.

While the trispecific Trop2/CDH17/CD3binding molecule mediated lysis of Trop2+/CDH17+ cells with good efficacy, this was not the case for the cell lines expressing only Trop2 or only CDH17, respectively, thus confirming the avidity enhanced biological activity of said trispecific molecules (see FIG. 9A). The specificity of the avidity approach was further supported by the fact that control molecules binding monovalently to either Trop2 (Trop2/TNP/CD3) or CDH17 (TNP/CDH17/CD3) were not able to induce significant target cell lysis. Bivalent binders for Trop2 and CDH17 in the same format were used as controls.

In order to confirm the avidity approach in a cancer setting (see FIG. 9B), the redirected T cell cytotoxicity was assessed in the Trop2/CDH17 co-expressing colorectal cancer cell line DLD-1 as well as a DLD-1 clone engineered to lack CDH17, thus only expressing Trop2. DLD-1 cells were obtained from ATCC and a CDH17-deficient DLD-1 clone was generated into which the reporter protein GFP was introduced. After 48 h, GFP-positive transfectants were isolated by flow cytometry (Sonysorter) and clones were separated by limiting dilution. CDH17 deficiency was confirmed by analysing clonal protein extracts for CDH17 content by Western Blotting using a CDH17-specific antibody.

The cytolysis of the Trop2+CDH17− clone was significantly reduced compared to the effect on the Trop2+CDH17+ parental cell line, thereby confirming the avidity-based potency increase. The activity of the Trop2/CDH17/CD3 binding molecules to the Trop2+CDH17− clone corresponded to the activity of a monovalent Trop2 binder (Trop2/TNP/CD3), thus confirming that the effect on Trop2+/CDH17− target cells is Trop2 mediated.

Figure 9:
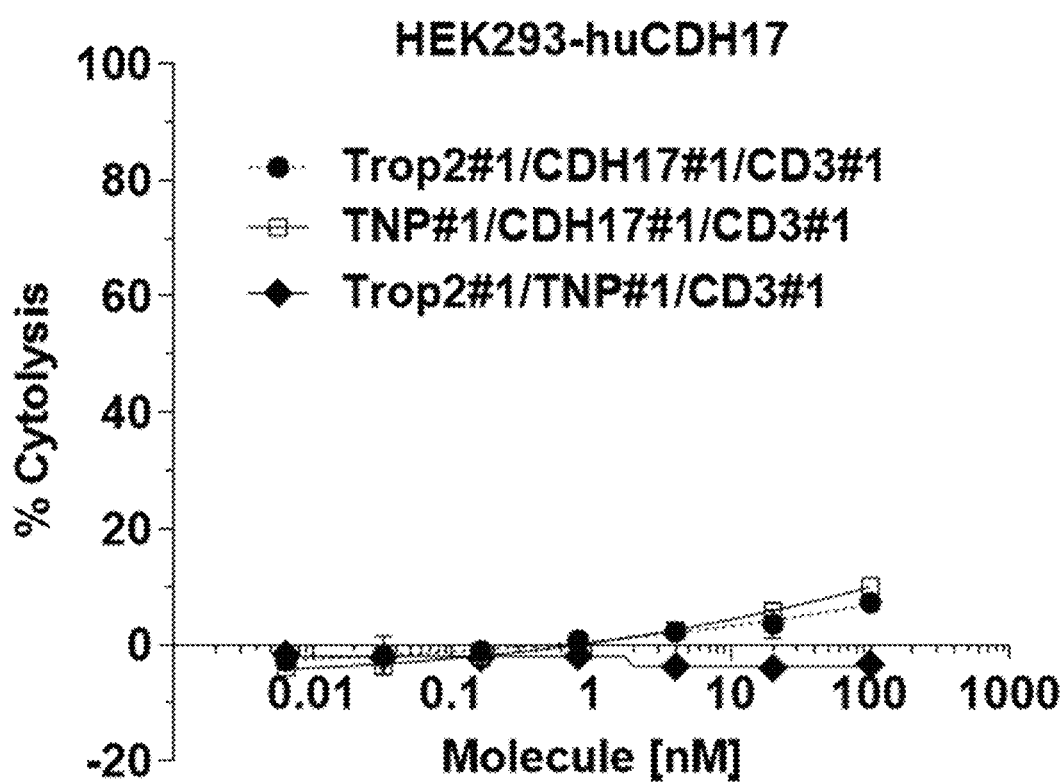
FIG. 9: Potency in mediating T cell induced lysis in cells either expressing CDH17, Trop2, or co-expressing both. Redirected T cell mediated lysis of HEK293 cells (A) recombinantly expressing either CDH17 (left), Trop2 (middle) or both (right), was assessed using various Trop2/CDH17/CD3 binders (shown in A is one exemplary Trop2/CDH17/CD3 binder) as well as various control molecules binding either monovalently or bivalently to only one target. Redirected T cell mediated lysis of DLD-1 derived cell lines (B) either expressing only Trop2 (left) or both CDH17 and Trop2 (right) was assessed using different Trop2/CDH17/CD3 binder combinations as well as a monovalent Trop2 binding control.
Figure 9:
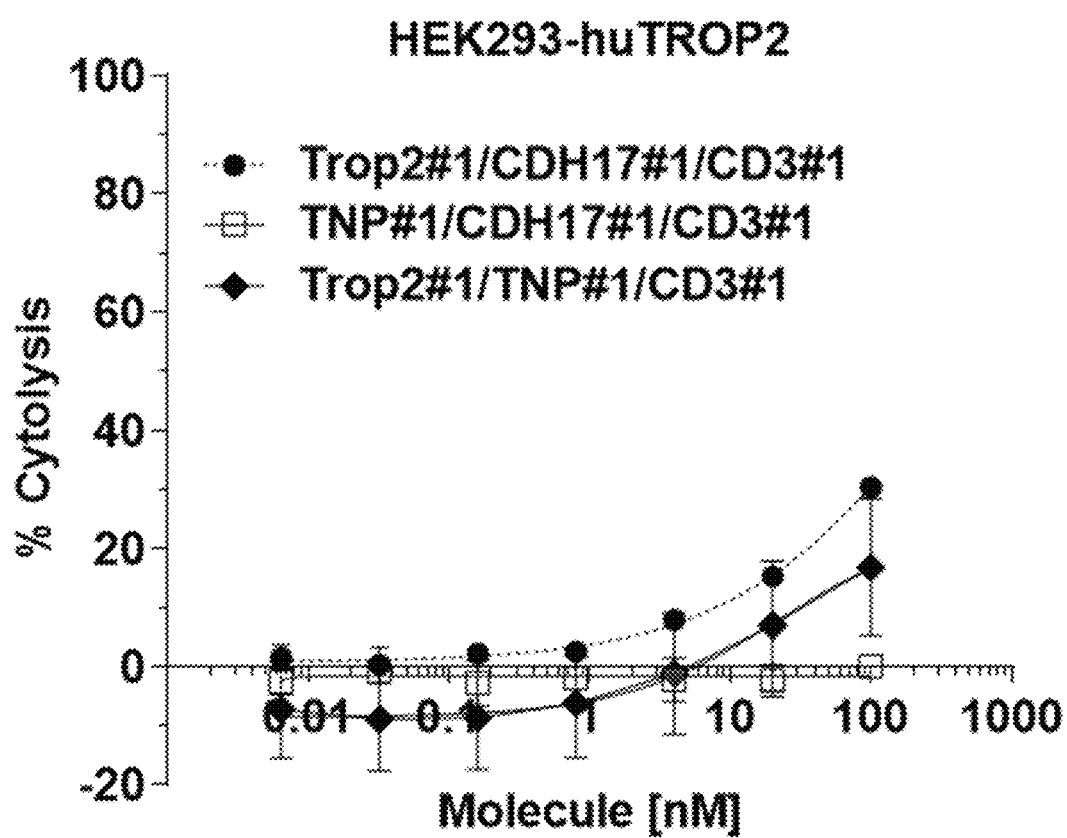
Figure 9:
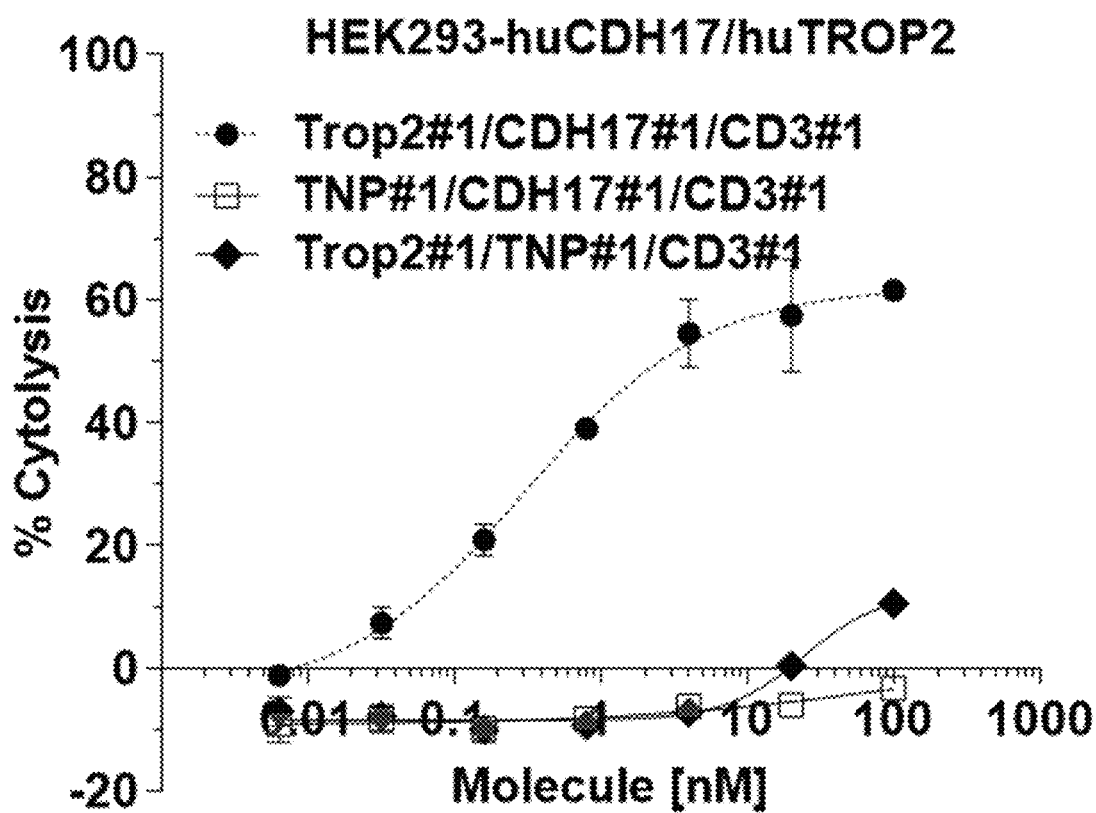
Figure 9:
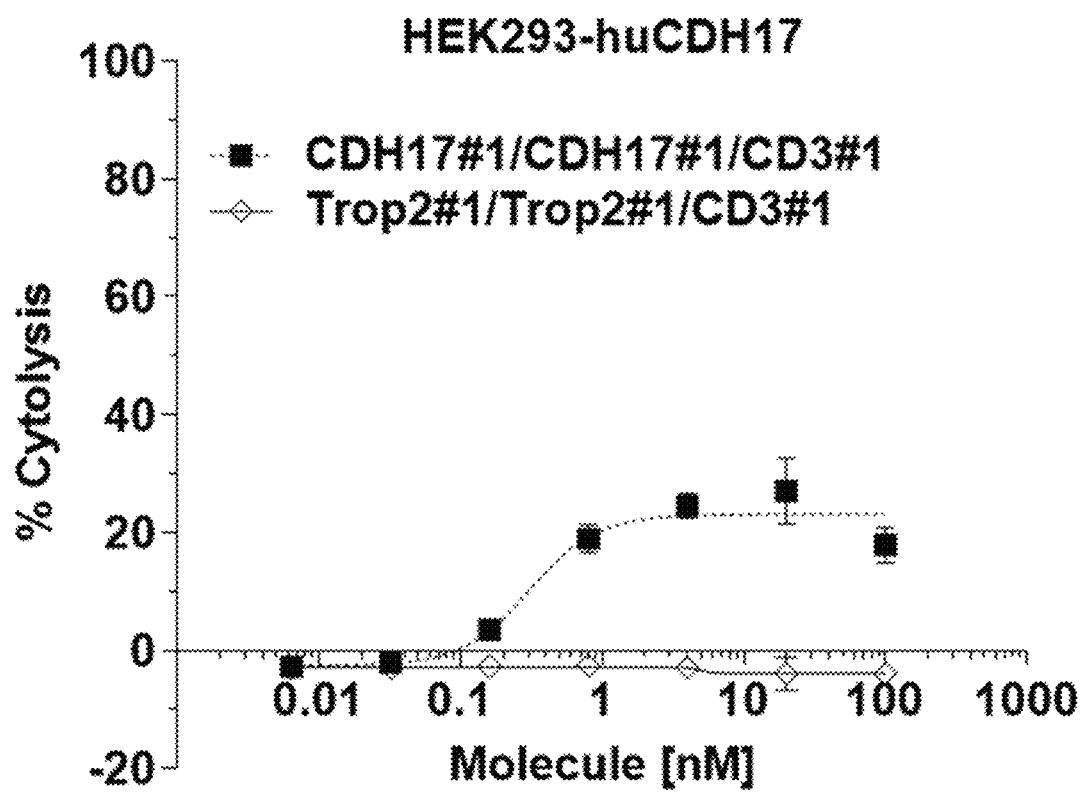
Figure 9:
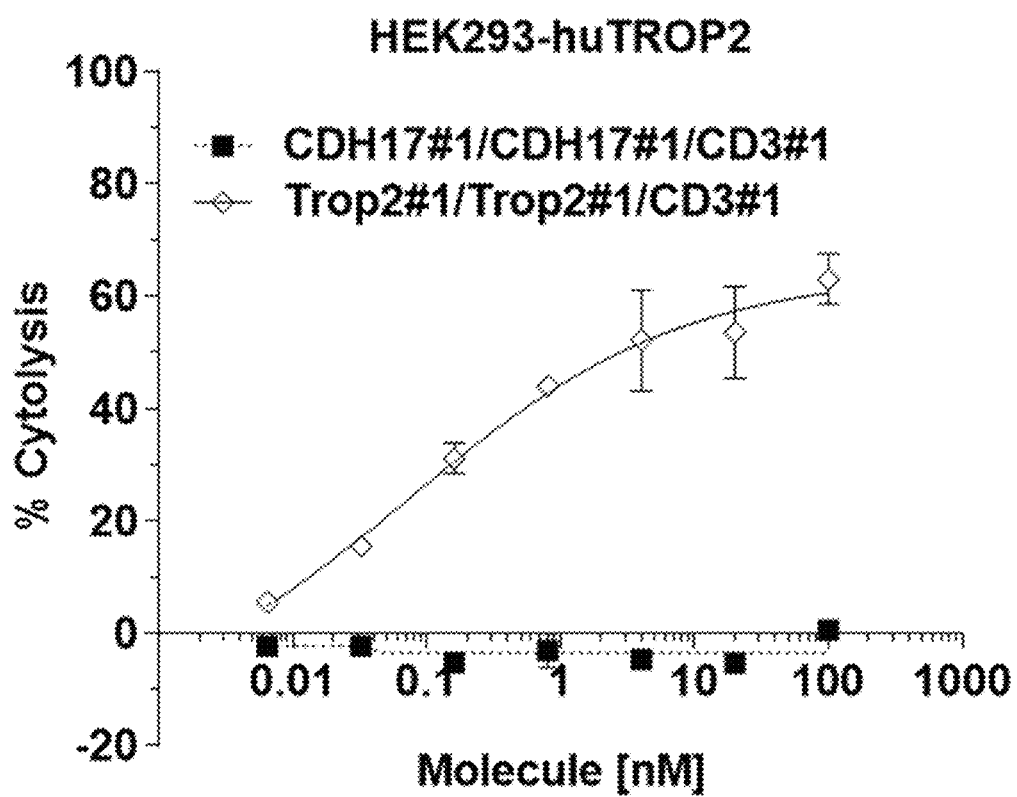
Figure 9:
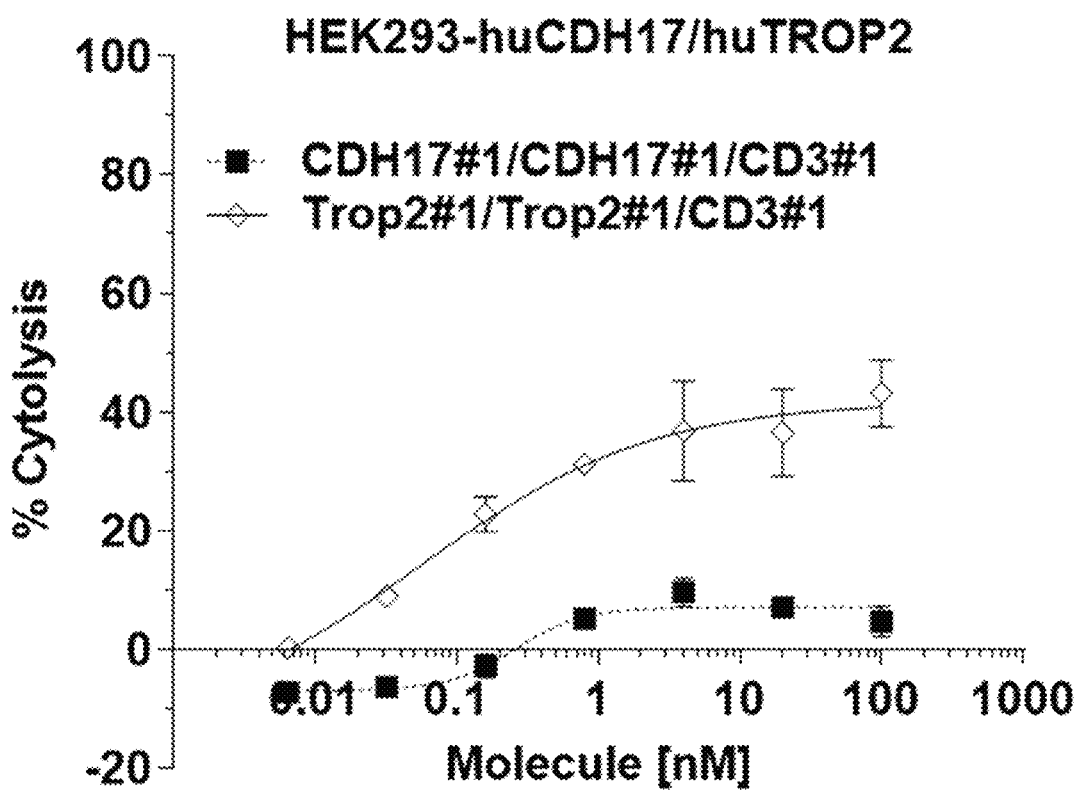
Figure 9:
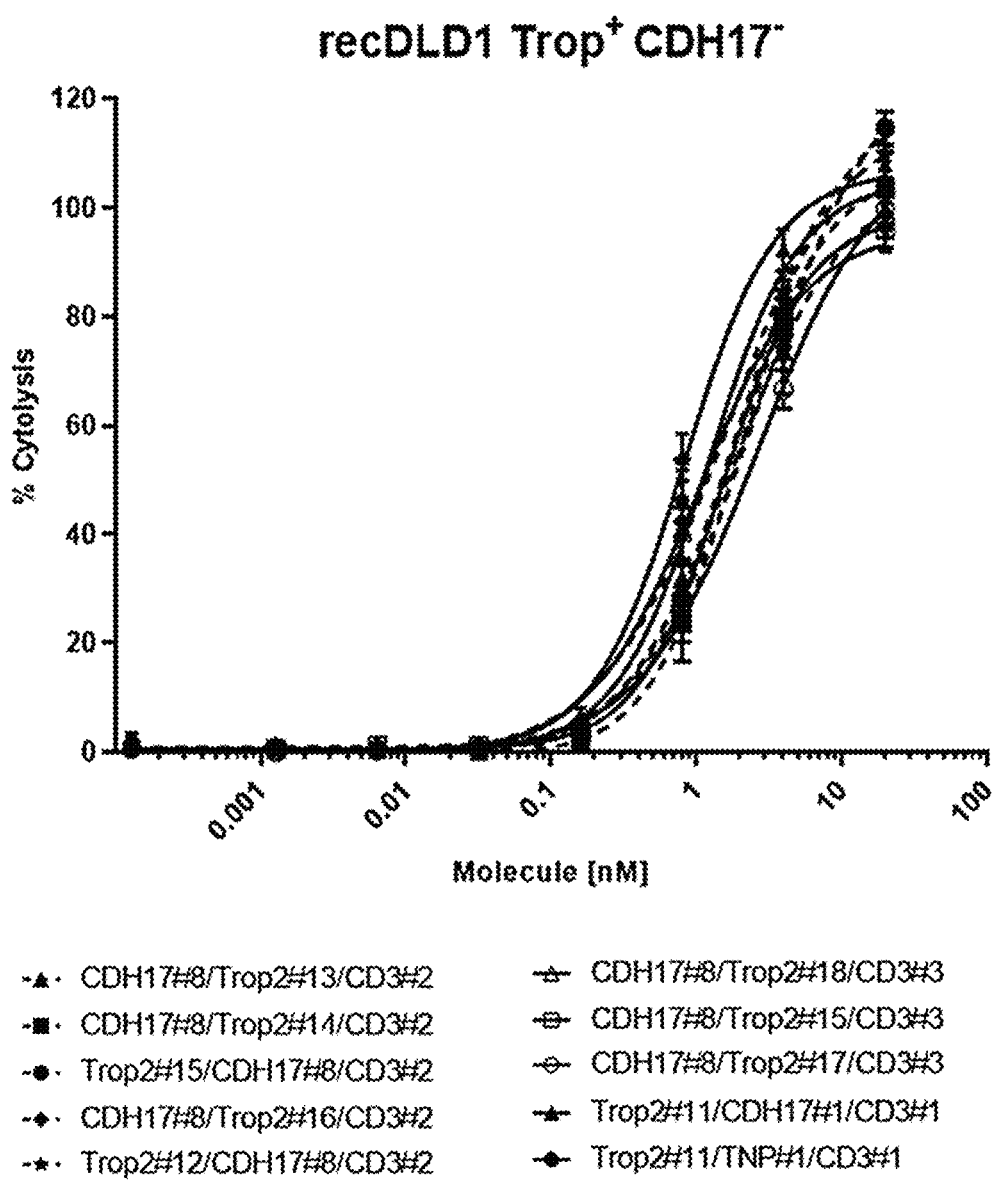
Figure 9:
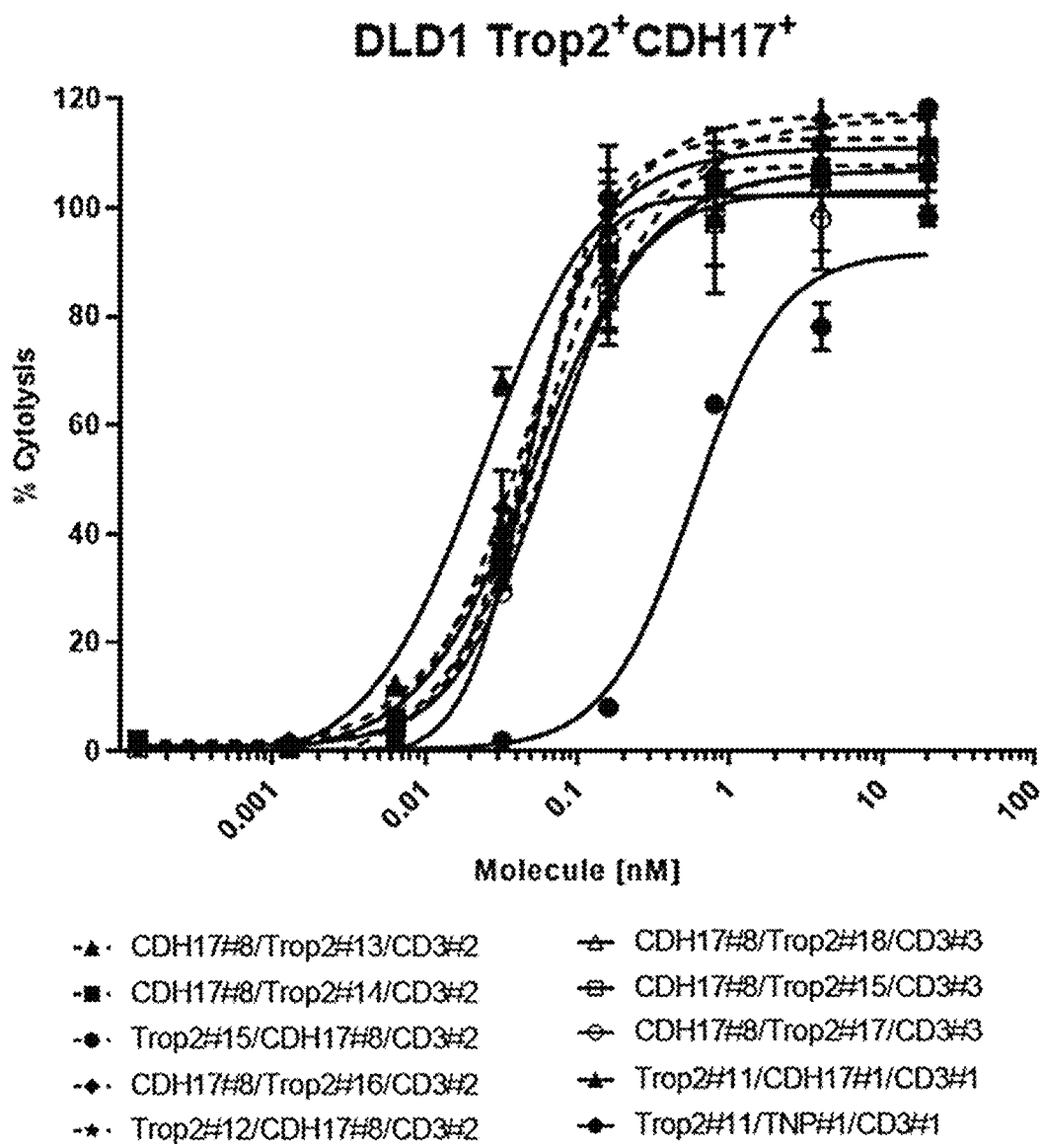

FIG. 9 shows functional data obtained with a selection of molecules representative of several exemplary combinations of Trop2 binders (Trop2 #1, #8, #9, #10, #11, #12, #13, #14, #15, #16, #17, #18) with CDH17 binders (CDH17 #1, #8) and CD3-binders (CD3 #1, #2, #3), for which an avidity-based potency increase is shown. The sequences of the respective binders can be found in Table 1.

Figure 10:
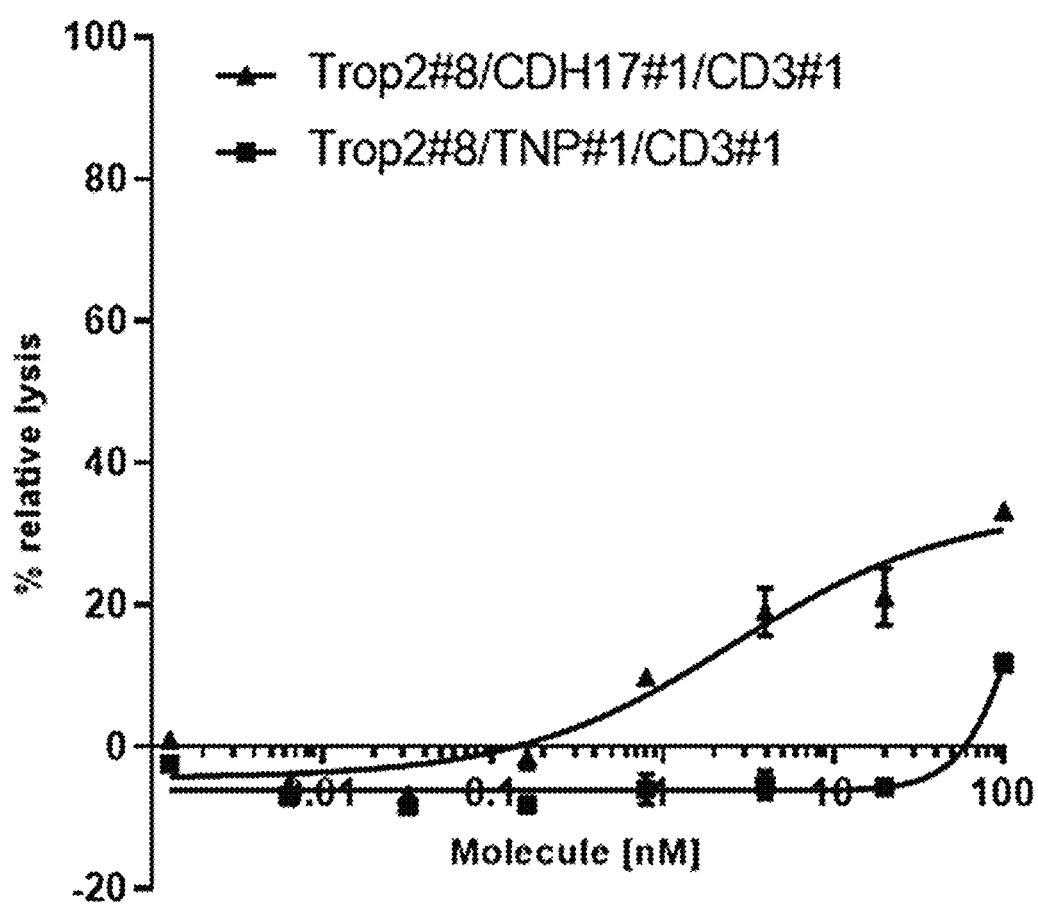
FIG. 10: Confirmation of CDH17 binding contribution to avidity induced potency increase. Redirected T cell mediated lysis of SK-CO1 cells was assessed using different Trop2/CDH17/CD3 molecules as well as Trop2/TNP/CD3 control molecules.
Figure 10:
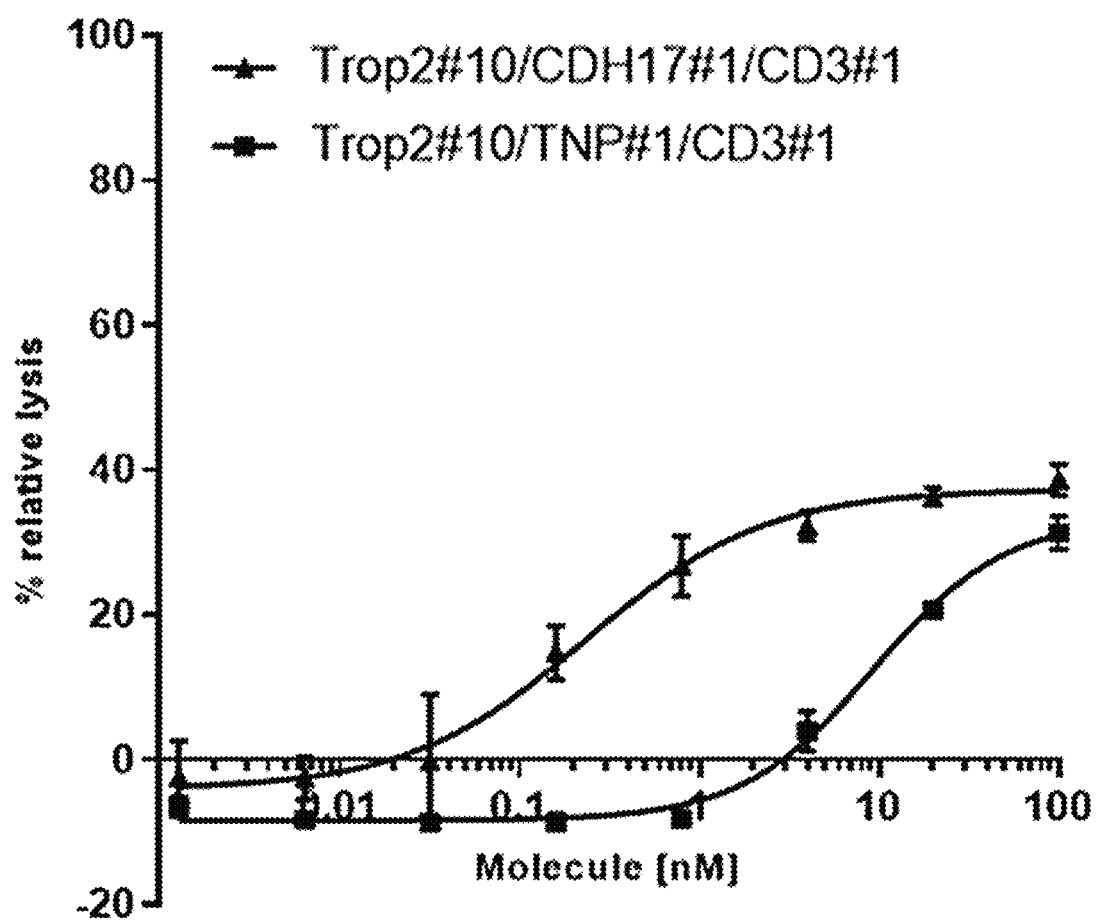
Figure 10:
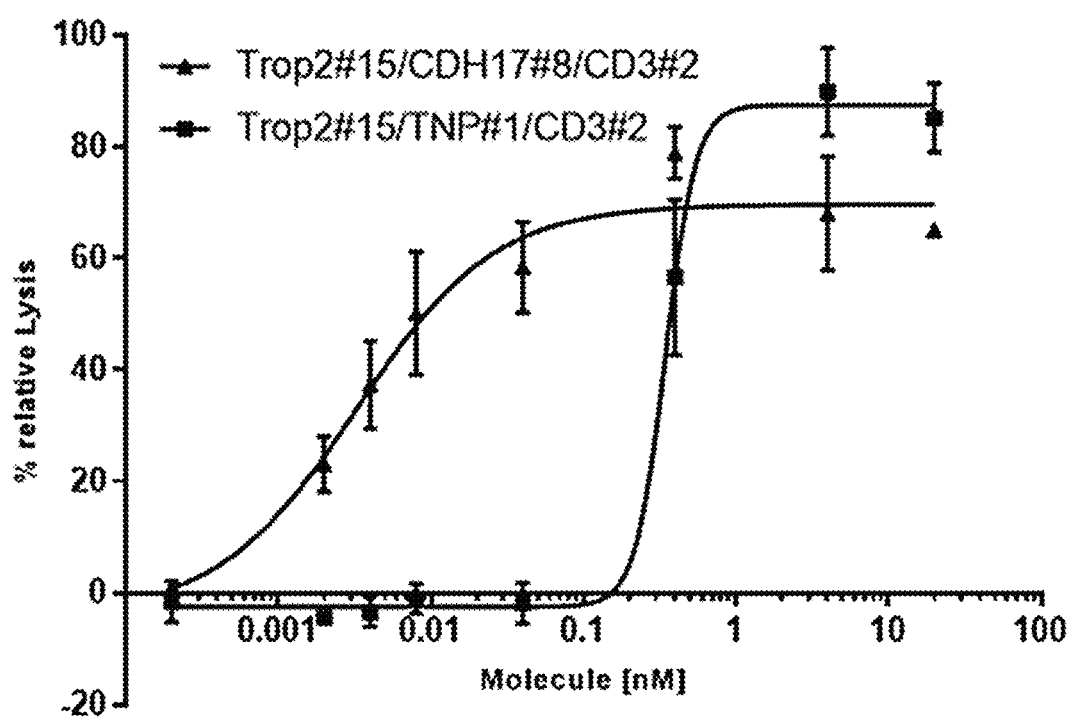
Figure 10:
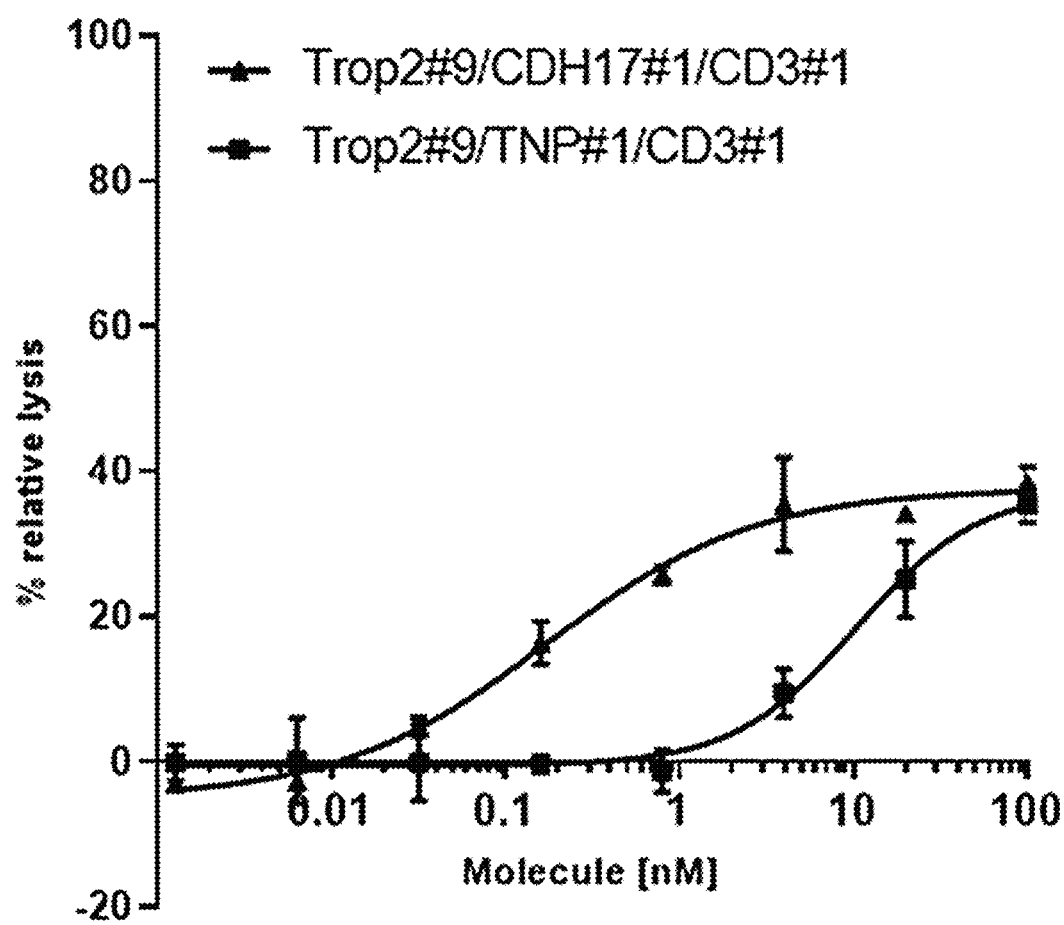
Figure 10:
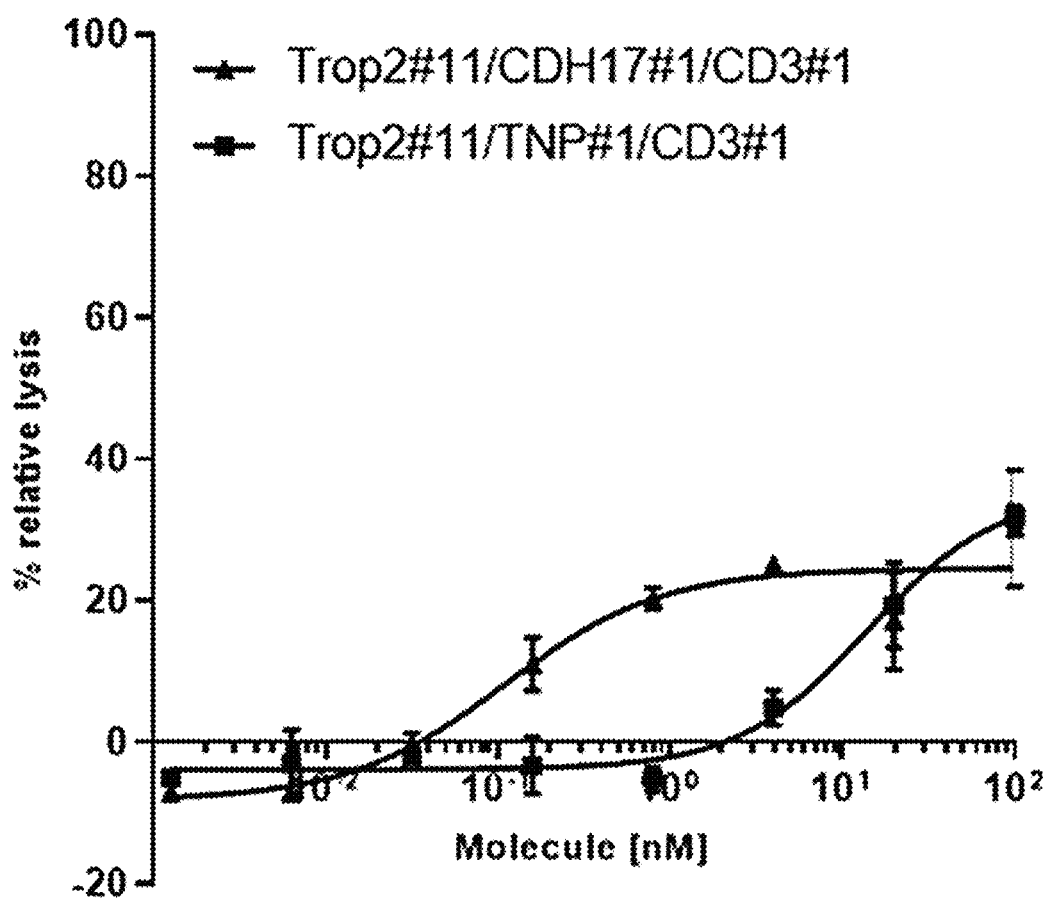

Example 10: Confirmation of CDH17 Binding Contribution to Avidity Induced Potency Increase In order to confirm the contribution of CDH17 binding to avidity induced potency increase, five different Trop2 binders were combined with either a CDH17 binding arm or a binder for the irrelevant target tetra-nitro-phenol (TNP) in Trop2/CDH17/CD3 or Trop2/TNP/CD3 binding molecules, respectively. In this assay, the Trop2/CDH17 positive colorectal cancer cell line SK-CO1 was co-cultured with unstimulated human T cells as effector cells and increasing concentrations of Trop2/CDH17/CD3 or Trop2/TNP/CD3 binding molecules for 72 hours at an effector to target cell ratio of 10:1. Trop2/CDH17/CD3 binding molecules were produced by transient transfection of CHO-E cells with the pTT5 vectors carrying the chain-encoding genes, as described in Example 4. Cytotoxic activity was determined as described in example 9. T cells were isolated from healthy donor PBMCs as described in example 6. The CDH17 binding arm led to a significant potency increase, with 40-60-fold increases in EC50 from Trop2/CDH17/CD3 vs Trop2/TNP/CD3; as shown in FIG. 10 (the sequences of the respective binders can be found in Table 1).

Example 11: Comparison of Knob-In-Hole Formats

Figure 11:
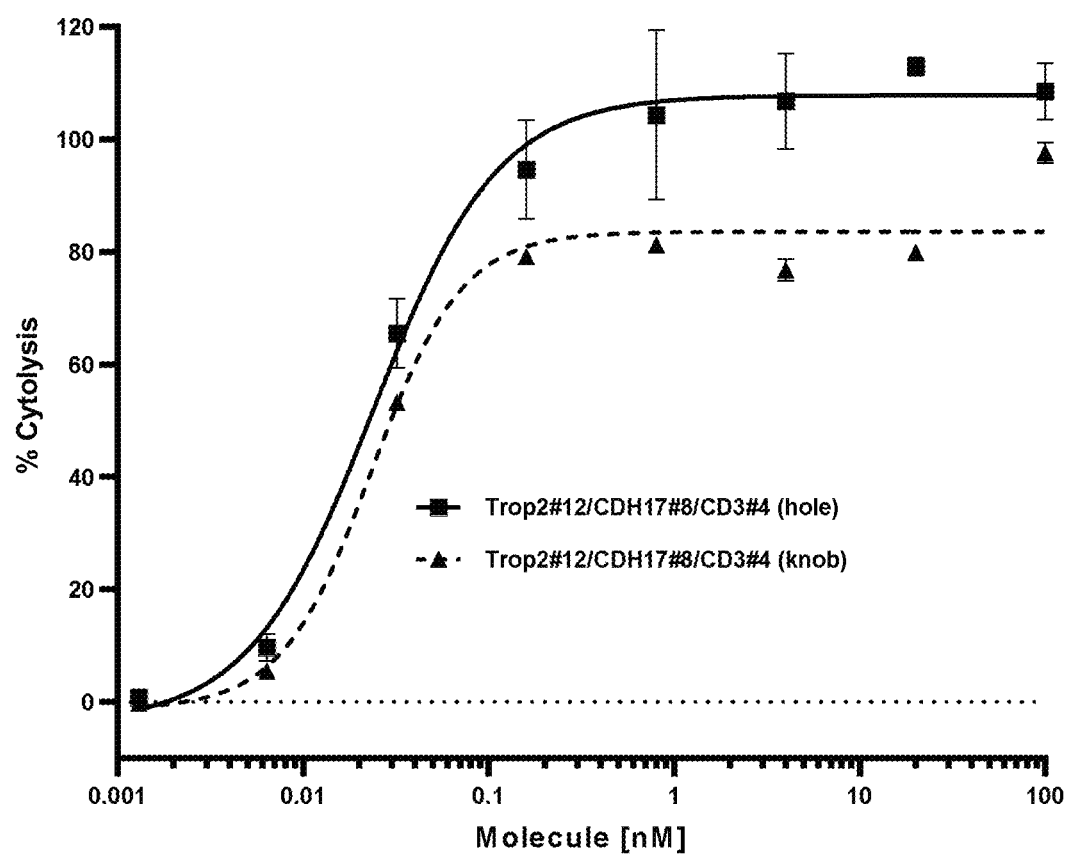
FIG. 11: Knob-in-hole format comparisons. Redirected T cell mediated lysis of SK-CO1 cells was assessed using trispecific molecules in two different knob-in-hole formats. The reference "hole" or "knob" in brackets in the legend indicates the location of the CDH17/CD3 arm, i.e. "hole" indicates that CDH17/CD3 is on the hole arm (see SEQ ID Nos:271, 272 and 424 to 427), while "knob" indicates that CDH17/CD3 is on the knob arm (see SEQ ID Nos:428 to 433).
Figure 11:
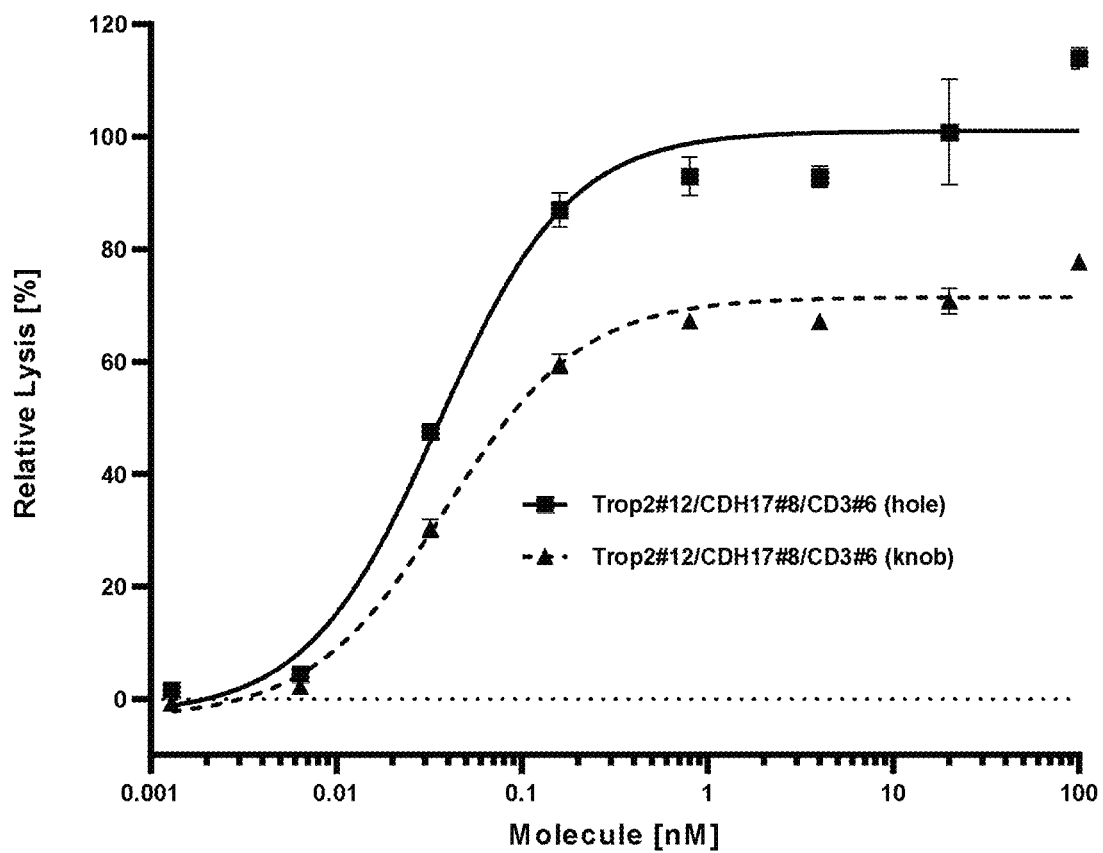
Figure 11:
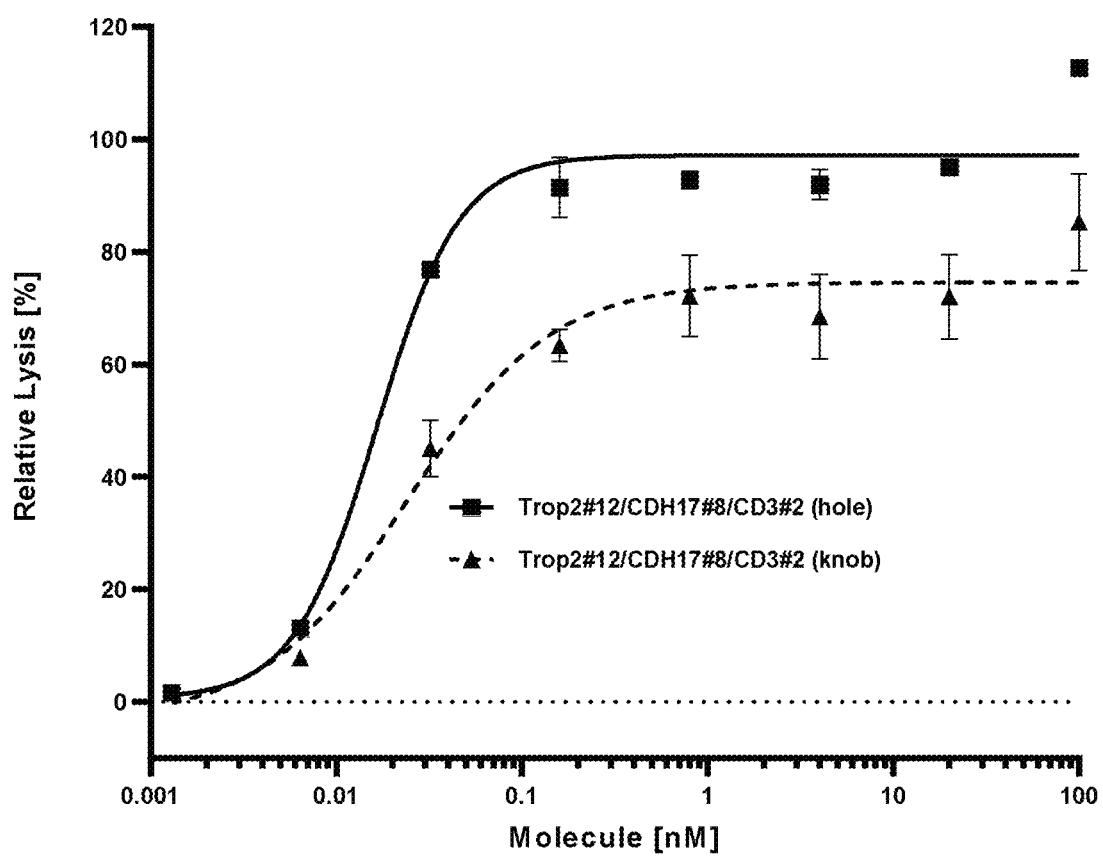
Figure 11:
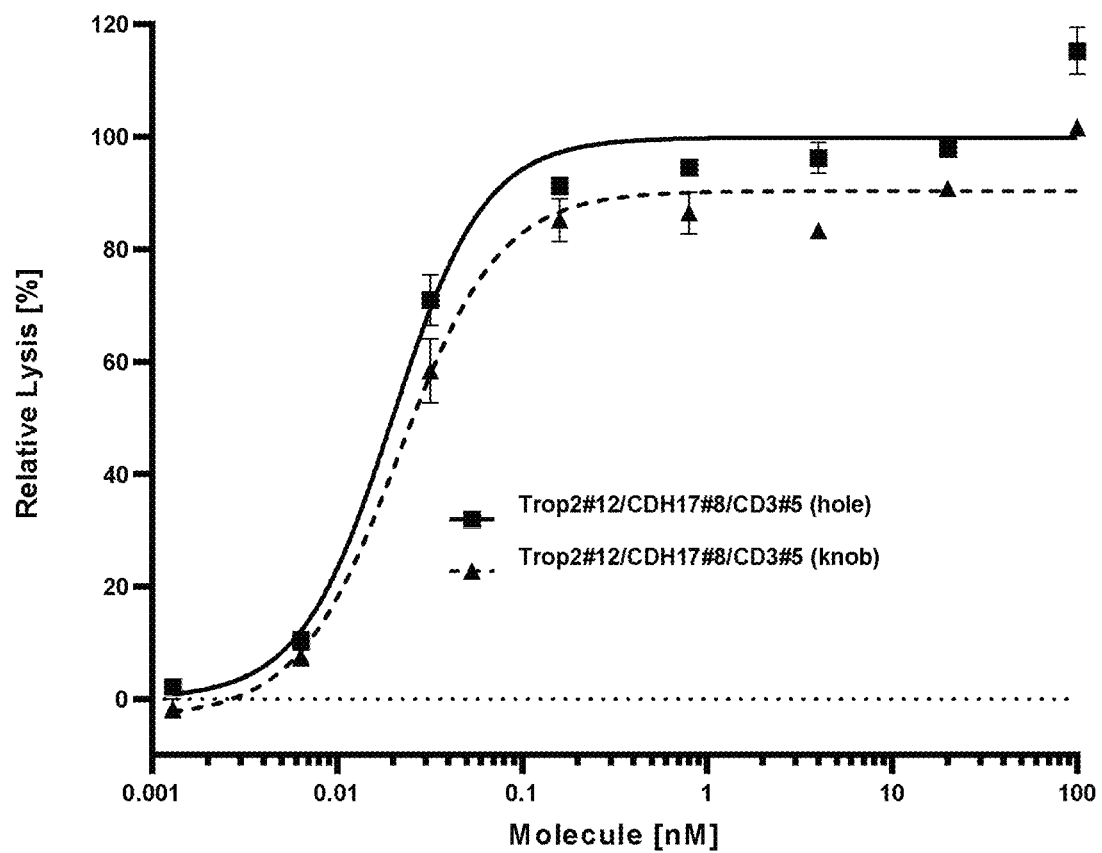
Figure 11:
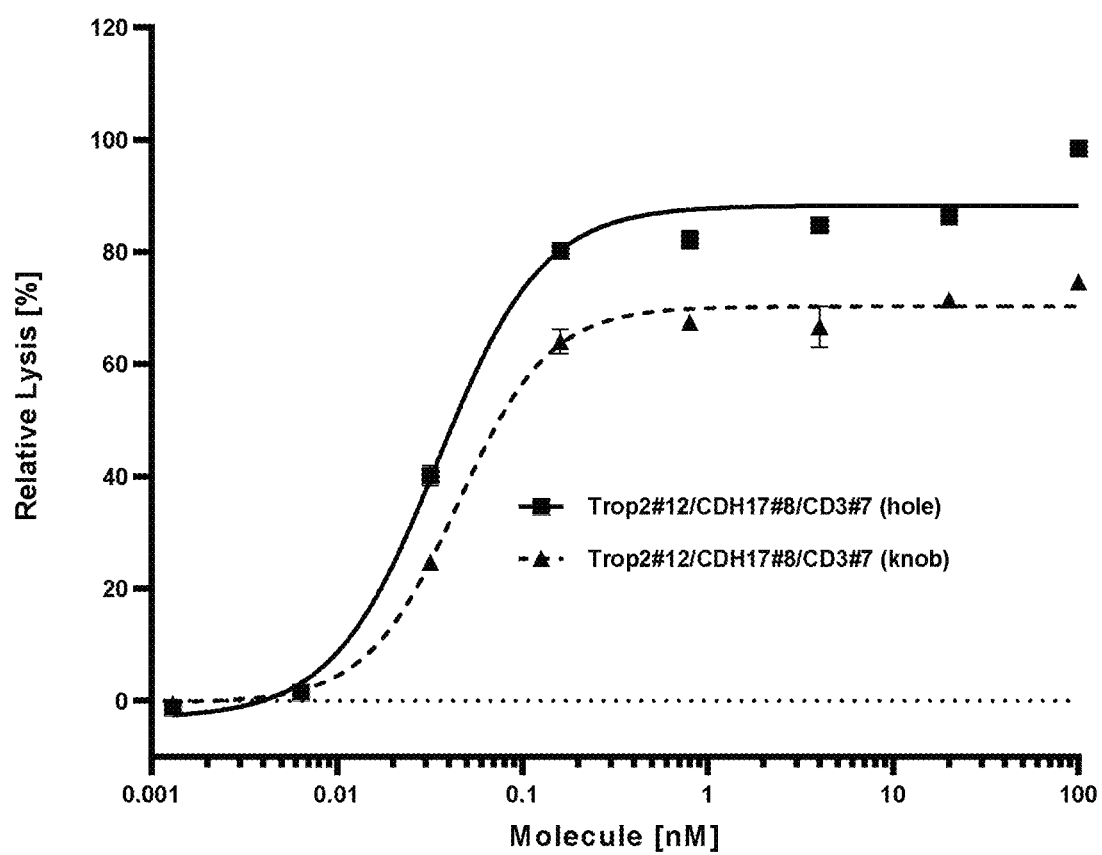
Figure 11:
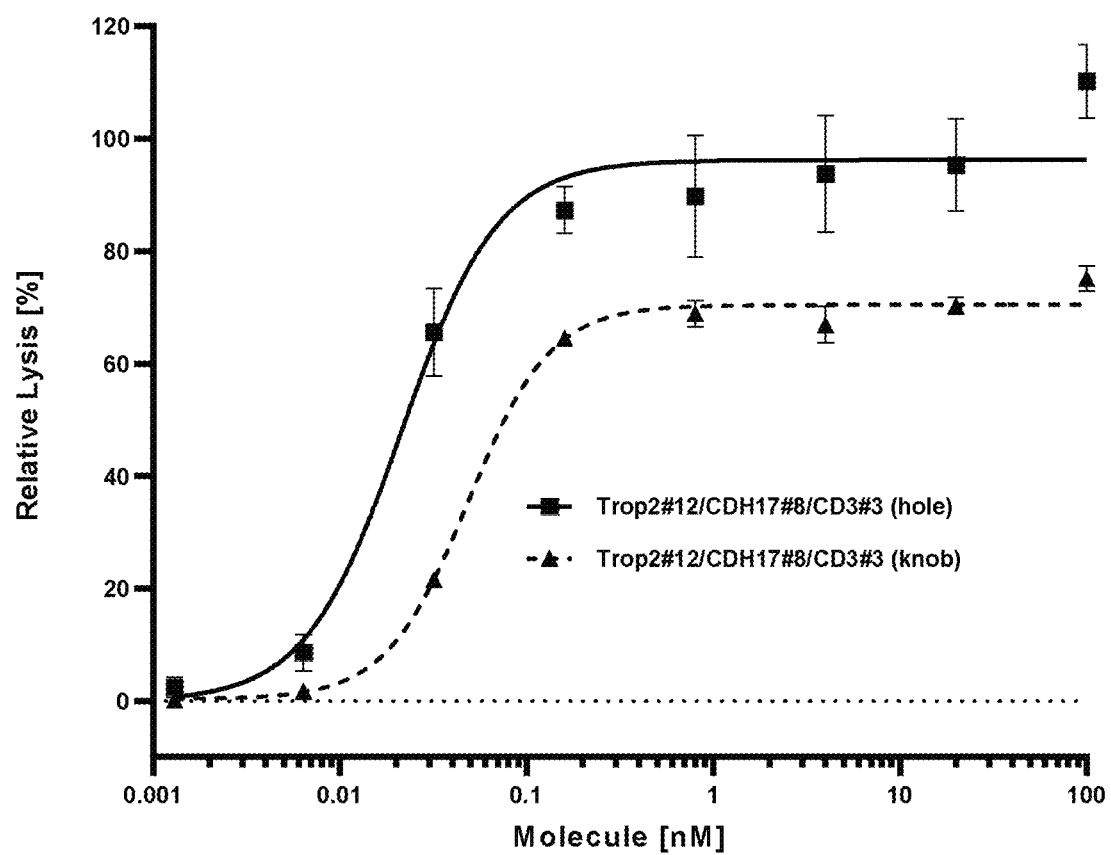

Trispecific molecules were produced in two different knob-in-hole formats (i.e. either Trop2 on the hole arm and CDH17/CD3 on the knob arm or vice versa) and their effect on T cell mediated cytotoxicity was assessed as described in Example 9. Whereas both types of formats worked well, it was surprisingly found that constructs where both CD3 and CDH17 binding portions were located on the hole part of the molecule consistently had higher potency irrespective of the binders used (see FIG. 11 for exemplary results; the sequences of the corresponding binders can be found in Table 1).

Example 12: Confirmation of Tumor Growth Inhibition In Vivo

Efficacy studies were performed using a human xenograft mouse model reconstituted with human T cells. In detail, human HPAF-II pancreatic cancer cells ($5 \times 10^7$) were injected subcutaneously (s.c.) into the right dorsal flank of NOG mice. In parallel, human T-cells were isolated from PBMCs by negative selection using the Pan T Cell Isolation Kit II (Miltenyi Biotec #130-091-156) as described above.

Subsequently T cells were expanded using the T Cell Activation/Expansion Kit human (Miltenyi Biotec Cat #130-091-441, Lot #5170720843) for 20 days. In brief, anti-Biotin MACSiBead™ Particles are loaded with CD2-, CD3-, CD28 Biotin and are transferred to the purified T cells in a ratio of 2 cells per particle and incubated in the presence of 20 Units recombinant IL-2 (R&D #202-IL-050/CF) at a density of 0.5-1 $10^6$ cells/ml for 20 days. Cells were supplemented with 20 Units fresh IL-2 every three days. Three days before injection into the animals, T cells were restimulated with anti-Biotin MACSiBead™ Particles loaded with CD2-, CD3-, CD28 Biotin at a ratio of 1 bead per 4 cells for an additional three days. Finally, beads were removed with a MACSiMAG Separator (Miltenyi Biotec) and T cells were washed in PBS.

On day 14, animals were randomized into treatment groups based on tumor volume and 2×10⁷ human T cells were injected intra-peritoneally (i.p.). Treatment with the trispecific molecules was started on day 17. Trop2/CDH17/CD3 binding protein, Trop2/TNP/CD3 binding protein, TNP/CDH17/CD3 binding protein or Vehicle buffer (50 mM NaOAc, 100 mM NaCl, pH 5.0) was administered in a once weekly dosing regimen by intravenous (i.v.) bolus injections into the lateral tail vein. Tumor growth was monitored by external caliper measurements and tumor volumes were calculated using a standard hemi-ellipsoid formula.

Human T cell engraftment was confirmed in the spleen by immunohistochemistry (IHC) staining for human CD3 at the end of the study. Only those animals showing human T-cell engraftment at the end of the study were included in the statistical analysis. Animals reaching sacrifice criteria were euthanized early during the studies for ethical reasons.

Figure 12:
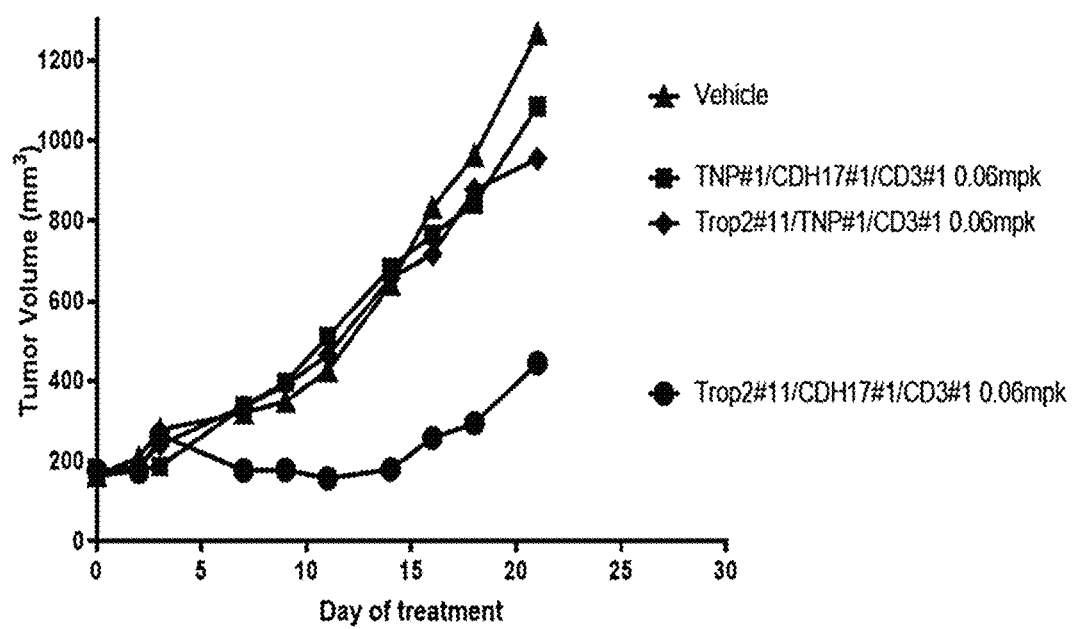
FIG. 12: Confirmation of tumour growth inhibition in vivo. Effect of different Trop2/CDH17/CD3 binders as well as a monovalent control binder on the growth of HPAF-II-derived xenograft tumours in a humanized mouse model.
Figure 12:
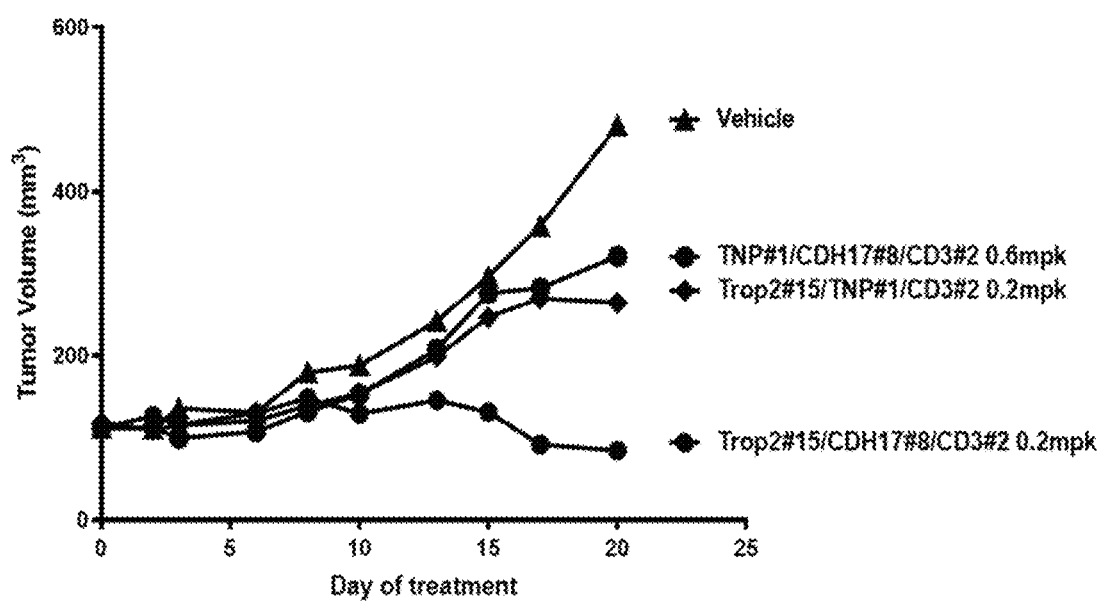

As shown in FIG. 12, treatment of tumor-bearing mice with trispecific Trop2/CDH17/CD3 binding molecules (represented by either the combination of SEQ ID NO:436 with 437 or the combination of SEQ ID NO:214 with 271) once weekly, but not with control Trop2/TNP/CD3 or TNP/CDH17/CD3 binding molecules at the same dose and treatment interval, induced significant tumor regression.

SEQUENCE LISTING (437 sequences)

SEQ ID NO: 1 - protein, 5 aa, Artificial Sequence
  Trop2#1 HCDR1
DYTMH

SEQ ID NO: 2 - protein, 17 aa, Artificial Sequence
  Trop2#1 HCDR2
GIYPNYGDTNYNEKFKD

SEQ ID NO: 3 - protein, 12 aa, Artificial Sequence
  Trop2#1 HCDR3
KTVLLRLRYFDV

SEQ ID NO: 4 - protein, 11 aa, Artificial Sequence
  Trop2#1 LCDR1
RASGNIHNYLA

SEQ ID NO: 5 - protein, 7 aa, Artificial Sequence
  Trop2#1 LCDR2
NAITLAD

SEQ ID NO: 6 - protein, 9 aa, Artificial Sequence
  Trop2#1 LCDR3
QHFWSTPFT

SEQ ID NO: 7 - protein, 5 aa, Artificial Sequence
  Trop2#8 HCDR1
RYSVH

SEQ ID NO: 8 - protein, 16 aa, Artificial Sequence
  Trop2#8 HCDR2
MIWGGGSTDYNSDFKP

SEQ ID NO: 9 - protein, 13 aa, Artificial Sequence
  Trop2#8 HCDR3
KGSYYTNYGAMDY

SEQ ID NO: 10 - protein, 11 aa, Artificial Sequence
  Trop2#8 LCDR1
KASQDINKYIA

SEQ ID NO: 11 - protein, 7 aa, Artificial Sequence
  Trop2#8 LCDR2
YTSTLQP

SEQ ID NO: 12 - protein, 8 aa, Artificial Sequence
  Trop2#8 LCDR3
LQYDNLWT

SEQ ID NO: 13 - protein, 6 aa, Artificial Sequence
  Trop2#11, #12, #13, #14, #15, #16, #17, #18 HCDR1
SGYYWN

SEQ ID NO: 14 - protein, 16 aa, Artificial Sequence
  Trop2#11 HCDR2
YISYDGRNNYNPSLKN

SEQ ID NO: 15 - protein, 8 aa, Artificial Sequence
  Trop2#11, #12, #13, #14, #15, #16, #17, #18 HCDR3
DTTAYFDY

SEQ ID NO: 16 - protein, 15 aa, Artificial Sequence
  Trop2#11 LCDR1
RASESVDSSVNRFMH

SEQ ID NO: 17 - protein, 7 aa, Artificial Sequence
  Trop2#11, #12, #13, #14, #15, #16, #17, #18 LCDR2
RASNLES

SEQ ID NO: 18 - protein, 9 aa, Artificial Sequence
  Trop2#11, #12, #13, #14, #15, #16, #17, #18 LCDR3
QQSNEDPYT

SEQ ID NO: 19 - protein, 16 aa, Artificial Sequence
  Trop2#12, #13, #14, #15, #16, #17, #18 HCDR2
YISYSGRNLYNPSLKS

SEQ ID NO: 20 - protein, 15 aa, Artificial Sequence
  Trop2#12, #13, #14, #15, #16, #17, #18 LCDR1
RASESVSSSVNRFLH

SEQ ID NO: 21 - protein, 5 aa, Artificial Sequence
  Trop2#9 HCDR1
DYYMN

SEQ ID NO: 22 - protein, 17 aa, Artificial Sequence
  Trop2#9 HCDR2
YIYPNNGATGYNQKFKG

SEQ ID NO: 23 - protein, 10 aa, Artificial Sequence
  Trop2#9 HCDR3
EDSYYYAMDY

SEQ ID NO: 24 - protein, 16 aa, Artificial Sequence
  Trop2#9 LCDR1
KSSQSLVHSNGNTFLH

SEQ ID NO: 25 - protein, 7 aa, Artificial Sequence
  Trop2#9, #10 LCDR2
KVSNRFS

SEQ ID NO: 26 - protein, 8 aa, Artificial Sequence
  Trop2#9 LCDR3
SQSTHVYT

SEQ ID NO: 27 - protein, 5 aa, Artificial Sequence
  Trop2#10 HCDR1
NYYIH

SEQ ID NO: 28 - protein, 17 aa, Artificial Sequence
  Trop2#10 HCDR2
YIYPGNGATAYNQKFKG

SEQ ID NO: 29 - protein, 9 aa, Artificial Sequence
  Trop2#10 HCDR3
EDYYYAMDY

SEQ ID NO: 30 - protein, 16 aa, Artificial Sequence
  Trop2#10 LCDR1
RSSQSLVHSNGNTYLH

SEQ ID NO: 31 - protein, 8 aa, Artificial Sequence
  Trop2#10 LCDR3
SQSTHVWT

SEQ ID NO: 32 - protein, 5 aa, Artificial Sequence
  CDH17#1, #8 HCDR1
DHTIH

SEQ ID NO: 33 - protein, 17 aa, Artificial Sequence
  CDH17#1 HCDR2
YIYPRDGSTKYNEKFKG

SEQ ID NO: 34 - protein, 14 aa, Artificial Sequence
  CDH17#1, #8 HCDR3
WGYYYGSSRYYFDY

SEQ ID NO: 35 - protein, 17 aa, Artificial Sequence
  CDH17#1 LCDR1
KSSQSLLYSSNQKNYLA

SEQ ID NO: 36 - protein, 7 aa, Artificial Sequence
  CDH17#1 LCDR2
WASTRES

SEQ ID NO: 37 - protein, 9 aa, Artificial Sequence
  CDH17#1, #8 LCDR3
QQYYSYPWT

SEQ ID NO: 38 - protein, 17 aa, Artificial Sequence
  CDH17#8 HCDR2
YIYPRLGSTKYAEKFQG

SEQ ID NO: 39 - protein, 17 aa, Artificial Sequence
  CDH17#8 LCDR1
RASQSVLYSSNQKQYLA

SEQ ID NO: 40 - protein, 7 aa, Artificial Sequence
  CDH17#8 LCDR2
GASTRET

SEQ ID NO: 41 - protein, 5 aa, Artificial Sequence
  all of CD3#1 to #25 HCDR1
TYAMN

SEQ ID NO: 42 - protein, 19 aa, Artificial Sequence
  all of CD3#1 to #5, CD3#8 to #16, #21, #24, #25 HCDR2
RIRSKYNNYATYYADSVKD

SEQ ID NO: 43 - protein, 14 aa, Artificial Sequence
  all of CD3#1 to #11, #13, #14, #16, #21, #24, #25 HCDR3
HGNFGNSYVSWFAY

SEQ ID NO: 44 - protein, 14 aa, Artificial Sequence
  all of CD3#1 to #11, #13, #14, #15 LCDR1
RSSTGAVTTSNYAN

SEQ ID NO: 45 - protein, 7 aa, Artificial Sequence
  all of CD3#1 to #13, #17, #19, #20, #22, #23, #24 LCDR2
GTNKRAP

SEQ ID NO: 46 - protein, 9 aa, Artificial Sequence
  CD3#2, #11 LCDR3
ALWYSNKWV

SEQ ID NO: 47 - protein, 9 aa, Artificial Sequence
  CD3#1, all of CD3#3 to #10, #13 to #16 LCDR3
ALWYSNLWV

SEQ ID NO: 48 - protein, 19 aa, Artificial Sequence
  CD3#6, #7, #17, #18, #19 HCDR2
RIRSKYNNYATYYADSVKG

SEQ ID NO: 49 - protein, 14 aa, Artificial Sequence
  CD3#12, #15 HCDR3
HGNFLNSYVSWFAY

SEQ ID NO: 50 - protein, 14 aa, Artificial Sequence
  CD3#12 LCDR1
RSSTGAVTTSYYAN

SEQ ID NO: 51 - protein, 9 aa, Artificial Sequence
  CD3#12 LCDR3
ALWYSNHWV

SEQ ID NO: 52 - protein, 7 aa, Artificial Sequence
  CD3#14, #15, #16, #18, #21, #25 LCDR2
GTNIRAP

SEQ ID NO: 53 - protein, 14 aa, Artificial Sequence
  CD3#16 LCDR1
ISSTGAVTTSNYAN

SEQ ID NO: 54 - protein, 14 aa, Artificial Sequence
  CD3#17, #18, #19, #22, #23 HCDR3
HGNFIDSYVSWFAY

SEQ ID NO: 55 - protein, 14 aa, Artificial Sequence
  CD3#17 LCDR1
GRSTGAVTTSNYAN

SEQ ID NO: 56 - protein, 14 aa, Artificial Sequence
  CD3#18, #23 LCDR1
GSSTGAVTTSWYAN

SEQ ID NO: 57 - protein, 14 aa, Artificial Sequence
  CD3#19, #22, #25 LCDR1
GSSTGAVTTSNYAN

SEQ ID NO: 58 - protein, 19 aa, Artificial Sequence
  CD3#20 HCDR2
RIRSIYNNYATYYADSVKG

SEQ ID NO: 59 - protein, 14 aa, Artificial Sequence
  CD3#20 HCDR3
HGNFGDSYVSWFAY

SEQ ID NO: 60 - protein, 14 aa, Artificial Sequence
  CD3#20 LCDR1
VSSTGAVTTSNYAN

SEQ ID NO: 61 - protein, 14 aa, Artificial Sequence
  CD3#21, #24 LCDR1
GSSTGAVTTSYYAN

SEQ ID NO: 62 - protein, 19 aa, Artificial Sequence
  CD3#22 HCDR2
RIRSIYNNYATYYADIVKG

SEQ ID NO: 63 - protein, 19 aa, Artificial Sequence
  CD3#23 HCDR2
RIRSKYNNYATYYADIVKG

SEQ ID NO: 64 - protein, 17 aa, Artificial Sequence
  CD3#26, #27 HCDR2
NINADTGSTNYNEKFKN

SEQ ID NO: 65 - protein, 10 aa, Artificial Sequence
  CD3#26, #27 HCDR3
DGYSFYYFDY

SEQ ID NO: 66 - protein, 17 aa, Artificial Sequence
  all of CD3#26 to #30, #33, #35, #37, #39, #42, #43 LCDR1
KSSQSLLNSRTRKNYLA

SEQ ID NO: 67 - protein, 7 aa, Artificial Sequence
  all of CD3#26 to #43 LCDR2
WASTRKS

SEQ ID NO: 68 - protein, 8 aa, Artificial Sequence
  all of CD3#26 to #43 LCDR3
IQSFILRT

SEQ ID NO: 69 - protein, 17 aa, Artificial Sequence
  CD3#28, #34 HCDR2
NINASTGSTNYNQKFKG

SEQ ID NO: 70 - protein, 10 aa, Artificial Sequence
  CD3#28, #32, #39, #42, #43 HCDR3
DAYSFYYFDY

SEQ ID NO: 71 - protein, 17 aa, Artificial Sequence
  CD3#31, #32, #34, #36 LCDR1
KSSQSLLNARTRKNYLA

SEQ ID NO: 72 - protein, 17 aa, Artificial Sequence
  CD3#29 HCDR2
NINASTGSTSYAEKFKG

SEQ ID NO: 73 - protein, 17 aa, Artificial Sequence
  CD3#30, #32 HCDR2
NINASTGSTNYAQKFQG

SEQ ID NO: 74 - protein, 17 aa, Artificial Sequence
  CD3#31 HCDR2
NINASTGSTNYAQKFKG

SEQ ID NO: 75 - protein, 17 aa, Artificial Sequence
  CD3#33 HCDR2
NINASTGSTSYNQKFKG

SEQ ID NO: 76 - protein, 17 aa, Artificial Sequence
  CD3#35 HCDR2
NINASTGSTSYNQKFQN

SEQ ID NO: 77 - protein, 17 aa, Artificial Sequence
  CD3#36 HCDR2
NINASTGSTNYNQKFQN

SEQ ID NO: 78 - protein, 17 aa, Artificial Sequence
  CD3#37 HCDR2
NINASTGSTSYAQKFKG

SEQ ID NO: 79 - protein, 17 aa, Artificial Sequence
  CD3#38, #40, #41 HCDR2
NINADTGSTKYNQKFKG

SEQ ID NO: 80 - protein, 17 aa, Artificial Sequence
  CD3#38, #40, #41 LCDR1
RSSQSLLNSRTRKNYLA

SEQ ID NO: 81 - protein, 17 aa, Artificial Sequence
  CD3#39, #42, #43 HCDR2
NINADTGSTNYNQKFQG

SEQ ID NO: 82 - protein, 5 aa, Artificial Sequence
  all of CD3#26 to #43 HCDR1
SYWMH

SEQ ID NO: 83 - protein, 121 aa, Artificial Sequence
  Trop2#1 VH
EVQLQQSGPELLKPGASVKISCKASGYTFTDYTMHWVKQSHGKSLEWIGGIYPNYGDTNYNEKFKDKATLTVDESSSTAYMELRSLTSEDSAVYYCSRKTVLLRLRYFDVWGTGTTVTVSS

SEQ ID NO: 84 - protein, 107 aa, Artificial Sequence
  Trop2#1 VL
DIQMTQSPASLSASVGETVTITCRASGNIHNYLAWYQQKQGKSPQLLVYNAITLADGVPSRFSGSGSGTQYSLKINSLQPEDFGSYYCQHFWSTPFTFGSGTKLEIK

SEQ ID NO: 85 - protein, 121 aa, Artificial Sequence
  Trop2#8 VH
QVQLKESGPGLVAPSQSLSITCTVSGLSLSRYSVHWVRQPPGKGLEWLGMIWGGGSTDYNSDFKPRLSISKDNSKSQVFLKMNSLQTDDTAMYYCARKGSYYTNYGAMDYWGQGTSVTVSS

SEQ ID NO: 86 - protein, 106 aa, Artificial Sequence
  Trop2#8 VL
DIQMTQSPSSLSASLGGKVTITCKASQDINKYIAWYQHKPGKGPRLLIHYTSTLQPGIPSRFSGSGSGRDYSFSISNLEPEDIATYYCLQYDNLWTFGGGTKLEIK

SEQ ID NO: 87 - protein, 119 aa, Artificial Sequence
  Trop2#9 VH
EVQLQQSGPEPVKPGASVKMSCKASGYTFTDYYMNWVKQSHGKSLEWIGYIYPNNGATGYNQKFKGKATLTVDKSSSTAYMELRSLTSEDSAVYYCAREDSYYYAMDYWGQGTSVTVSS

SEQ ID NO: 88 - protein, 111 aa, Artificial Sequence
  Trop2#9 VL
DVVMTQTPLSLPVSLGDQASISCKSSQSLVHSNGNTFLHWYLQKPGQSPKLLIYKVSNRFSGVPDRFSGSGSGTDFTLKINRVEAEDLGVYFCSQSTHVYTFGGGTKLEIK

SEQ ID NO: 89 - protein, 118 aa, Artificial Sequence
  Trop2#10 VH
QIQLQQSGPELVKPGAPVKISCKASGYTFTNYYIHWVKQRPGQGLEWIGYIYPGNGATAYNQKFKGKATLTADNPSSTAYMQLSSLTSEDSAVYFCAREDYYYAMDYWGQGTSVTVSS

SEQ ID NO: 90 - protein, 110 aa, Artificial Sequence
  Trop2#10 VL
VVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVWTFGGGTKLEIK

SEQ ID NO: 91 - protein, 117 aa, Artificial Sequence
  Trop2#11 VH
DVQLQESGPGLVKPSQSLSLTCSVTGYSITSGYYWNWIRQFPGNKLEWMGYISYDGRNNYNPSLKNRISITRDTSENQFFLKLNSVTPEDTATYYCARDTTAYFDYWGQGTTLTVSS

SEQ ID NO: 92 - protein, 111 aa, Artificial Sequence
  Trop2#11 VL
DIVLTQSPPSLAVSLGQRATISCRASESVDSSVNRFMHWYQQKPGQPPKLLIYRASNLESGIPARFSGSGSRTDFTLTINPVEADDVATYYCQQSNEDPYTFGGGTKLEIK

SEQ ID NO: 93 - protein, 112 aa, Artificial Sequence
  Trop2#12 VH
DVLMTQTPLSLPVSLGDQASISCRSSQNIVHSNGNTYLDWYLQKPGQSPKLLIYKVSNRFSGVPDRFSGSGSGTDFTLKISRVEAEDLGVYYCFQGSHVPPTFGAGTKLELK

SEQ ID NO: 94 - protein, 111 aa, Artificial Sequence
  Trop2#12 and #13 VL
DIQMTQSPSSLSASVGDRVTITCRASESVSSSVNRFLHWYQQKPGKAPKLLIYRASNLESGVPSRFSGSGSGTDFTLTISSLQPEDFATYYCQQSNEDPYTFGQGTKLEIK

SEQ ID NO: 95 - protein, 117 aa, Artificial Sequence
  Trop2#13, #14, #15 and #17 VH
QVQLQESGPGLVKPSQTLKLTCTVSGYSISSGYYWNWIRQPPGKGLEWIGYISYSGRNLYNPSLKSRVTISRDTSKNQFSLKLSSVTAADTAVYYCARDTTAYFDYWGQGTLVTVSS

SEQ ID NO: 96 - protein, 111 aa, Artificial Sequence
  Trop2#14 and #18 VL
DIQMTQSPSSLSASVGDRVTITCRASESVSSSVNRFLHWYQQKPGKAPKLLIYRASNLESGVPSRFSGKGSGTDFTLTISSLQPEDFATYYCQQSNEDPYTFGQGTKLEIK

SEQ ID NO: 97 - protein, 111 aa, Artificial Sequence
  Trop2#15 and #16 VL
DIQMTQSPSSLSASVGDRVTITCRASESVSSSVNRFLHWYQQKPGKAPKLLIYRASNLESGVPSRFSGSGSGTDFTLTIRSLQPEDFATYYCQQSNEDPYTFGQGTKLEIK

SEQ ID NO: 98 - protein, 117 aa, Artificial Sequence
  Trop2#16 and #18 VH
QVQLQESGPGLVKPSQTLSLTCTVSGYSISSGYYWNWIRQPPGKGLEWIGYISYSGRNLYNPSLKSRVTISRDTSKNQFSLKLSRVTAADTAVYYCARDTTAYFDYWGQGTLVTVSS

SEQ ID NO: 99 - protein, 111 aa, Artificial Sequence
  Trop2#17 VL
DIRMTQSPSSLSASVGDRVTITCRASESVSSSVNRFLHWYQQKPGKAPKLLIYRASNLESGVPSRFSGSGSGTDFTLTISSLQPEDFATYYCQQSNEDPYTFGQGTKLEIK

SEQ ID NO: 100 - protein, 123 aa, Artificial Sequence
  CDH17#1 VH
QVQLQQSDAELVKPGASVKISCKVSGYTFTDHTIHWMKQRPEQGLEWIGYIYPRDGSTKYNEKFKGKATLTADKSSSTAYMQLNSLTSEDSAVYFCARWGYYYGSSRYYFDYWGQGTTLTVSS

SEQ ID NO: 101 - protein, 113 aa, Artificial Sequence
  CDH17#1 VL
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPWTFGGGTKLEIK

SEQ ID NO: 102 - protein, 123 aa, Artificial Sequence
  CDH17#8 VH
QVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSS

SEQ ID NO: 103 - protein, 113 aa, Artificial Sequence
  CDH17#8 VL
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIK

SEQ ID NO: 104 - protein, 125 aa, Artificial Sequence
  All of CD3#1 to #4, #8 to #11, #13, #14, #16, #21 VH
EVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 105 - protein, 109 aa, Artificial Sequence
  CD3#1 VL
EAVVTQEPSLTVSPGGTVTLTCRSSTGAVTTSNYANWVQEKPGQLPRGLIGGTNKRAPWVPARFSGSLLGGKAALTLSGAQPEDEAEYFCALWYSNLWVFGGGTKLTVL

SEQ ID NO: 106 - protein, 109 aa, Artificial Sequence
  CD3#2 VL
EAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNKWVFGGGTKLTVL

SEQ ID NO: 107 - protein, 109 aa, Artificial Sequence
  CD3#3, #4 VL
EAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGGGTKLTVL

SEQ ID NO: 108 - protein, 125 aa, Artificial Sequence
  CD3#5 VH
EVQLVESGGGLVQPGGSLKLSCAASGFTFNTYAMNWVRQAPGKCLEWVARIRSKYNNYATYYADSVKDRFTISRDDSKNTAYLQMNNLKTEDTAVYYCVRHGNFGNSYVSWFAYWGQGTLVTVSA

SEQ ID NO: 109 - protein, 109 aa, Artificial Sequence
  CD3#5 VL
EAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGCGTKLTVL

SEQ ID NO: 110 - protein, 125 aa, Artificial Sequence
  CD3#6 VH
EVQLVESGGGLVQPGGSLKLSCAASGFTFNTYAMNWVRQAPGKGLEWVARIRSKYNNYATYYADSVKGRFTISRDDSKNTAYLQMNNLKTEDTAVYYCVRHGNFGNSYVSWFAYWGQGTLVTVSA

SEQ ID NO: 111 - protein, 109 aa, Artificial Sequence
  CD3#6 VL
QAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGGGTKLTVL

SEQ ID NO: 112 - protein, 125 aa, Artificial Sequence
  CD3#7 VH
EVQLVESGGGLVQPGGSLKLSCAASGFTFNTYAMNWVRQAPGKCLEWVARIRSKYNNYATYYADSVKGRFTISRDDSKNTAYLQMNNLKTEDTAVYYCVRHGNFGNSYVSWFAYWGQGTLVTVSA

SEQ ID NO: 113 - protein, 109 aa, Artificial Sequence
  CD3#7 VL
QAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGCGTKLTVL

SEQ ID NO: 114 - protein, 109 aa, Artificial Sequence
  CD3#8 VL
QAVVTQEPSLTVSPGGTVTLTCRSSTGAVTTSNYANWVQQKPGQLPRGLIGGTNKRAPWVPARFSGSLLGGKAALTLSGAQPEDEAEYFCALWYSNLWVFGGGTKLTVL

SEQ ID NO: 115 - protein, 109 aa, Artificial Sequence
  CD3#9 VL
EAVVTQEPSLTVSPGGTVTLTCRSSTGAVTTSNYANWVQQKPGQLPRGLIGGTNKRAPWVPARFSGSLLGGKAALTLSGAQPEDEAEYFCALWYSNLWVFGGGTKLTVL

SEQ ID NO: 116 - protein, 109 aa, Artificial Sequence
  CD3#10 VL
EAVVTQEPSLTVSPGGTVTLTCRSSTGAVTTSNYANWVQQKPGQLPRGLIGGTNKRAPGVPARFSGSLLGGKAALTLSGAQPEDEAEYFCALWYSNLWVFGGGTKLTVL

SEQ ID NO: 117 - protein, 109 aa, Artificial Sequence
  CD3#11 VL
EAVVTQEPSLTVSPGGTVTLTCRSSTGAVTTSNYANWVQQKPGQLPRGLIGGTNKRAPGVPARFSGSLLGGKAALTLSGAQPEDEAEYFCALWYSNKWVFGGGTKLTVL

SEQ ID NO: 118 - protein, 125 aa, Artificial Sequence
  CD3#12 VH
EVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFLNSYVSWFAYWGQGTLVTVSA

SEQ ID NO: 119 - protein, 109 aa, Artificial Sequence
  CD3#12 VL
EAVVTQEPSLTVSPGGTVTLTCRSSTGAVTTSYYANWVQQKPGKSPRGLIGGTNKRAPGVPARFSGSLLGGKAALTISGAQPEDEADYYCALWYSNHWVFGGGTKLTVL

SEQ ID NO: 120 - protein, 109 aa, Artificial Sequence
  CD3#13 VL
EAVVTQEPSLTVSPGGTVTLTCRSSTGAVTTSNYANWVQQKPGKSPRGLIGGTNKRAPGVPARFSGSLLGGKAALTISGAQPEDEADYYCALWYSNLWVFGVGTKLTVL

SEQ ID NO: 121 - protein, 109 aa, Artificial Sequence
  CD3#14 VL
EAVVTQEPSLTVSPGGTVTLTCRSSTGAVTTSNYANWVQQKPGKSPRGLIGGTNIRAPGVPARFSGSLLGGKAALTISGAQPEDEADYYCALWYSNLWVFGYGTKLTVL

SEQ ID NO: 122 - protein, 109 aa, Artificial Sequence
  CD3#15 VL
EAVVTQEPSLTVSPGGTVTLTCRSSTGAVTTSNYANWVQQKPGKSPRGLIGGTNIRAPGVPARFSGSLLGGKAALTISGAQPEDEAWYFCALWYSNLWVFGGGTKLTVL

SEQ ID NO: 123 - protein, 109 aa, Artificial Sequence
  CD3#16 VL
QAVVTQEPSLTVSPGGTVTLTCISSTGAVTTSNYANWVQQKPGKSPRGLIGGTNIRAPGVPARFSGSLLGGKAALTISGAQPEDEADYYCALWYSNLWVFGGGTKLTVL

SEQ ID NO: 124 - protein, 125 aa, Artificial Sequence
  CD3#17, #18, #19 VH
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFIDSYVSWFAYWGQGTLVTVSS

SEQ ID NO: 125 - protein, 109 aa, Artificial Sequence
  CD3#17 VL
QAVVTQEPSLTVSPGGTVTLTCGRSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 126 - protein, 109 aa, Artificial Sequence
  CD3#18 VL
QAVVTQEPSLTVSPGGTVTLTCGSSTGAVTTSWYANWVQQKPGKSPRGLIGGTNIRAPGVPARFSGSLLGGKAALTISGAQPEDEADYYCALWYSNHWVFGGGTKLTVL

SEQ ID NO: 127 - protein, 109 aa, Artificial Sequence
  CD3#19, #20, #22 VL
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 128 - protein, 125 aa, Artificial Sequence
  CD3#20 VH
EVQLVESGGGLVQPGGSLRLSCAASGFTFSTYAMNWVRQAPGKGLEWVGRIRSIYNNYATYYADSVKGRFTISRDDSKNTLYLQMNSLRAEDTAVYYCVRHGNFGDSYVSWFAYWGQGTLVTVSS

SEQ ID NO: 129 - protein, 109 aa, Artificial Sequence
  CD3#21 VL
QAVVTQEPSLTVSPGGTVTLTCGSSTGAVTTSYYANWVKQKPGKSPRGLIGGTNIRAPGVPARFSGSLLGGKAALTISGAQPEDEADYYCALWYSNHWVFGGGTKLTVL

SEQ ID NO: 130 - protein, 125 aa, Artificial Sequence
  CD3#22 VH
EVQLVESGGGLVQPGGSLRLSCAASGFTFSTYAMNWVRQAPGKGLEWVGRIRSIYNNYATYYADIVKGRFTISRDDSKNTLYLQMNSLRAEDTAVYYCVRHGNFIDSYVSWFAYWGQGTLVTVSS

SEQ ID NO: 131 - protein, 125 aa, Artificial Sequence
  CD3#23 VL
EVQLVESGGGLVQPGGSLRLSCAASGFTFSTYAMNWVRQAPGKGLEWVGRIRSKYNNYATYYADIVKGRFTISRDDSKNTLYLQMNSLRAEDTAVYYCVRHGNFIDSYVSWFAYWGQGTLVTVSS

SEQ ID NO: 132 - protein, 109 aa, Artificial Sequence
  CD3#23 VL
QAVVTQEPSLTVSPGGTVTLTCGSSTGAVTTSWYANWVQQKPGKSPRGLIGGTNKRAPGVPARFSGSLLGGKAALTISGAQPEDEADYYCALWYSNHWVFGGGTKLTVL

SEQ ID NO: 133 - protein, 125 aa, Artificial Sequence
  CD3#24, #25 VH
EVQLVESGGGLVQPGGSLRLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 134 - protein, 109 aa, Artificial Sequence
  CD3#24 VL
QAVVTQEPSLTVSPGGTVTLTCGSSTGAVTTSYYANWVQQKPGKSPRGLIGGTNKRAPGVPARFSGSLLGGKAALTISGAQPEDEADYYCALWYSNHWVFGGGTKLTVL

SEQ ID NO: 135 - protein, 109 aa, Artificial Sequence
  CD3#25 VL
QAVVTQEPSLTVSPGGTVTLTCGSSTGAVTTSNYANWVQQKPGKSPRGLIGGTNIRAPGVPARFSGSLLGGKAALTISGAQPEDEADYYCALWYSNHWVFGGGTKLTVL

SEQ ID NO: 136 - protein, 119 aa, Artificial Sequence
  CD3#26 VH
QVQLQQPGAELGKPGTSVKLSCKASGYTFTSYWMHWVKQRPGQGLEWIGNINADTGSTNYNEKFKNRATLTVDKSSSTAYMQLSTLTSEDSAVYYCTRDGYSFYYFDYWGQGTTLTVSS

SEQ ID NO: 137 - protein, 112 aa, Artificial Sequence
  CD3#26 VL
DIVMSQSPSSLAVSAGEKVTMFCKSSQSLLNSRTRKNYLAWYQQKPGQSPKLLIYWASTRKSGVPDRFTGSGSGTDFTLTISSVQAEDLAIYYCIQSFILRTFGGGTKLEIK

SEQ ID NO: 138 - protein, 119 aa, Artificial Sequence
  CD3#27 VH
QVQLVQSGAEVKKPGASVKVSCKASGYTFTSYWMHWVRQAPGQGLEWMGNINADTGSTNYNEKFKNRVTMTRDTSTSTVYMELSSLRSEDTAVYYCARDGYSFYYFDYWGQGTTVTVSS

SEQ ID NO: 139 - protein, 112 aa, Artificial Sequence
  CD3#27, #39 VL
DIVMTQSPDSLAVSLGERATINCKSSQSLLNSRTRKNYLAWYQQKPGQPPKLLIYWASTRKSGVPDRFSGSGSGTDFTLTISSLQAEDVAVYYCIQSFILRTFGQGTKLEIK

SEQ ID NO: 140 - protein, 119 aa, Artificial Sequence
  CD3#28 VH
QVQLVQSGAEVKKPGASVKVSCKASGYTFTSYWMHWVRQAPGQGLEWMGNINASTGSTNYNQKFKGRVTMTVDTSTSTVYMELSSLRSEDTAVYYCTRDAYSFYYFDYWGQGTTLTVSS

SEQ ID NO: 141 - protein, 112 aa, Artificial Sequence
  CD3#28, #29, #30, #42 VL
DIVMTQSPDSLAVSLGERATIFCKSSQSLLNSRTRKNYLAWYQQKPGQPPKLLIYWASTRKSGVPDRFSGSGSGTDFTLTISSLQAEDVAIYYCIQSFILRTFGQGTKLEIK

SEQ ID NO: 142 - protein, 119 aa, Artificial Sequence
  CD3#29 VH
QVQLVQSGAEVKKPGASVKVSCKASGYTFTSYWMHWVRQAPGQGLEWMGNINASTGSTSYAEKFKGRVTMTVDTSTSTVYMELSSLRSEDTAVYYCTRDGYSFYYFDYWGQGTTLTVSS

SEQ ID NO: 143 - protein, 119 aa, Artificial Sequence
  CD3#30 VH
QVQLVQSGAEVKKPGASVKVSCKASGYTFTSYWMHWVRQAPGQGLEWMGNINASTGSTNYAQKFQGRVTMTVDTSTSTVYMELSSLRSEDTAVYYCTRDGYSFYYFDYWGQGTTLTVSS

SEQ ID NO: 144 - protein, 119 aa, Artificial Sequence
  CD3#31 VH
QVQLVQSGAEVKKPGASVKVSCKASGYTFTSYWMHWVRQAPGQGLEWMGNINASTGSTNYAQKFKGRVTMTVDTSTSTVYMELSSLRSEDTAVYYCTRDGYSFYYFDYWGQGTTLTVSS

SEQ ID NO: 145 - protein, 112 aa, Artificial Sequence
  CD3#31, #32
DIVMTQSPDSLAVSLGERATIFCKSSQSLLNARTRKNYLAWYQQKPGQPPKLLIYWASTRKSGVPDRFSGSGSGTDFTLTISSLQAEDVAIYYCIQSFILRTFGQGTKLEIK

SEQ ID NO: 146 - protein, 119 aa, Artificial Sequence
  CD3#32 VH
QVQLVQSGAEVKKPGASVKVSCKASGYTFTSYWMHWVRQAPGQGLEWMGNINASTGSTNYAQKFQGRVTMTVDTSTSTVYMELSSLRSEDTAVYYCTRDAYSFYYFDYWGQGTTLTVSS

SEQ ID NO: 147 - protein, 119 aa, Artificial Sequence
  CD3#33 VH
QVQLVQSGAEVKKPGASVKVSCKASGYTFTSYWMHWVRQAPGQGLEWIGNINASTGSTSYNQKFKGRVTMTRDTSTSTVYMELSSLRSEDTAVYYCARDGYSFYYFDYWGQGTTVTVSS

SEQ ID NO: 148 - protein, 112 aa, Artificial Sequence
  CD3#33, #35, #37, #43 VL
DIVMTQSPDSLAVSLGERATMFCKSSQSLLNSRTRKNYLAWYQQKPGQPPKLLIYWASTRKSGVPDRFSGSGSGTDFTLTISSLQAEDVAVYYCIQSFILRTFGQGTKLEIK

SEQ ID NO: 149 - protein, 119 aa, Artificial Sequence
  CD3#34 VH
QVQLVQSGAEVKKPGASVKVSCKASGYTFTSYWMHWVRQAPGQGLEWIGNINASTGSTNYNQKFKGRVTMTRDTSTSTVYMELSSLRSEDTAVYYCARDGYSFYYFDYWGQGTTVTVSS

SEQ ID NO: 150 - protein, 112 aa, Artificial Sequence
  CD3#34 VL
DIVMTQSPDSLAVSLGERATMFCKSSQSLLNARTRKNYLAWYQQKPGQPPKLLIYWASTRKSGVPDRFSGSGSGTDFTLTISSLQAEDVAVYYCIQSFILRTFGQGTKLEIK

SEQ ID NO: 151 - protein, 119 aa, Artificial Sequence
  CD3#35 VH
QVQLVQSGAEVKKPGASVKVSCKASGYTFTSYWMHWVRQAPGQGLEWIGNINASTGSTSYNQKFQNRVTMTRDTSTSTVYMELSSLRSEDTAVYYCARDGYSFYYFDYWGQGTTVTVSS

SEQ ID NO: 152 - protein, 119 aa, Artificial Sequence
  CD3#36 VH
QVQLVQSGAEVKKPGASVKVSCKASGYTFTSYWMHWVRQAPGQGLEWIGNINASTGSTNYNQKFQNRVTMTRDTSTSTVYMELSSLRSEDTAVYYCARDGYSFYYFDYWGQGTTVTVSS

SEQ ID NO: 153 - protein, 119 aa, Artificial Sequence
  CD3#37 VH
QVQLVQSGAEVKKPGASVKVSCKASGYTFTSYWMHWVRQAPGQGLEWIGNINASTGSTSYAQKFKGRVTMTRDTSTSTVYMELSSLRSEDTAVYYCARDGYSFYYFDYWGQGTTVTVSS

SEQ ID NO: 154 - protein, 119 aa, Artificial Sequence
  CD3#38 VH
QVQLVQSGAEVKKPGASVKVSCKASGYTFTSYWMHWVRQAPGQGLEWMGNINADTGSTKYNQKFKGRVTMTRDTSTSTVYMELSSLRSEDTAVYYCARDGYSFYYFDYWGQGTTVTVSS

SEQ ID NO: 155 - protein, 112 aa, Artificial Sequence
  CD3#38 VL
DIVMTQSPDSLAVSLGERATINCRSSQSLLNSRTRKNYLAWYQQKPGQPPKLLIYWASTRKSGVPDRFSGSGSGTDFTLTISSLQAEDVAVYYCIQSFILRTFGQGTKLEIK

SEQ ID NO: 156 - protein, 119 aa, Artificial Sequence
  CD3#39 VH
QVQLVQSGAEVKKPGASVKVSCKASGYTFTSYWMHWVRQAPGQGLEWMGNINADTGSTNYNQKFQGRVTMTRDTSTSTVYMELSSLRSEDTAVYYCARDAYSFYYFDYWGQGTTVTVSS

SEQ ID NO: 157 - protein, 119 aa, Artificial Sequence
  CD3#40 VH
QVQLVQSGAEVKKPGASVKVSCKASGYTFTSYWMHWVRQAPGQGLEWMGNINADTGSTKYNQKFKGRVTMTVDTSTSTVYMELSSLRSEDTAVYYCTRDGYSFYYFDYWGQGTTLTVSS

SEQ ID NO: 158 - protein, 112 aa, Artificial Sequence
  CD3#40 VL
DIVMTQSPDSLAVSLGERATIFCRSSQSLLNSRTRKNYLAWYQQKPGQPPKLLIYWASTRKSGVPDRFSGSGSGTDFTLTISSLQAEDVAIYYCIQSFILRTFGQGTKLEIK

SEQ ID NO: 159 - protein, 119 aa, Artificial Sequence
  CD3#41 VH
QVQLVQSGAEVKKPGASVKVSCKASGYTFTSYWMHWVRQAPGQGLEWIGNINADTGSTKYNQKFKGRVTMTRDTSTSTVYMELSSLRSEDTAVYYCARDGYSFYYFDYWGQGTTVTVSS

SEQ ID NO: 160 - protein, 112 aa, Artificial Sequence
  CD3#41 VL
DIVMTQSPDSLAVSLGERATMFCRSSQSLLNSRTRKNYLAWYQQKPGQPPKLLIYWASTRKSGVPDRFSGSGSGTDFTLTISSLQAEDVAVYYCIQSFILRTFGQGTKLEIK

SEQ ID NO: 161 - protein, 119 aa, Artificial Sequence
  CD3#42 VH
QVQLVQSGAEVKKPGASVKVSCKASGYTFTSYWMHWVRQAPGQGLEWMGNINADTGSTNYNQKFQGRVTMTVDTSTSTVYMELSSLRSEDTAVYYCTRDAYSFYYFDYWGQGTTLTVSS

SEQ ID NO: 162 - protein, 119 aa, Artificial Sequence
  CD3#43 VH
QVQLVQSGAEVKKPGASVKVSCKASGYTFTSYWMHWVRQAPGQGLEWIGNINADTGSTNYNQKFQGRVTMTRDTSTSTVYMELSSLRSEDTAVYYCARDAYSFYYFDYWGQGTTVTVSS

SEQ ID NO: 163 - protein, 111 aa, Artificial Sequence
  Trop2#5 VL
DVVMTQTPLSLPVSLGDQASISCRSSQSLVHSHGNIYLHWYLQKPGLSPKLLIFKVSNRFSGVPDRFSGSGSGTDFTLKISRVEAEDLGVYFCSQSTHVWTFGGGTKLEIK

SEQ ID NO: 164 - protein, 118 aa, Artificial Sequence
  Trop2#5 VH
EVQLQQSGPDLVKPGASVKMSCKASGFIFTDYYMNWVKQSHGKSLEWIGYIYPNNGATAYNQKFKGKATLTVDKSSSTAYMELRSLTSEDSAVYYCARESDFYAMDYWGQGTSVTVSS

SEQ ID NO: 165 - protein, 106 aa, Artificial Sequence
  Trop2#7 VL
DIQMTQSSSSFSVSLGDRVTITCKASEDIYNRLAWFQQKPGNAPRLLISGATSLETGVPSRFRGSRSGKDYTLSITSLQTEDVATYYCQQYWSTWTFGGGTKLEIK

SEQ ID NO: 166 - protein, 120 aa, Artificial Sequence
  Trop2#7 VH
EVQLQQSGPELVKPGASVKMSCRASGYTFTSYAMHWVKQKPGQGLEWIGYINPYNGGTKYNEKFKGRATLTSDKSSSTAYMELSSLTSEDSAVYYCAREGIYYGAWFAYWGQGTLVTVSA

SEQ ID NO: 167 - protein, 121 aa, Artificial Sequence
  TNP VH
QIQLVQSGPELKKPGETVKISCKTSGYTFTNYGMNWVKQAPGKGLKWVGWINTYTGEPKYADDFKGRFAFSVETSASTAYLQINNLKNEDTATYFCARGIYDGYHWYFDVWGAGTTVTVSS

SEQ ID NO: 168 - protein, 112 aa, Artificial Sequence
  TNP VL
DVVMTQTPLSLPVSLGDQASISCRSSQSLVHSIGNTYLHWYLQKPGQSPKLLIYKVSNRFSGVPDRFSGSGSGTDFTLKITRVEAEDLGVYFCSQSTHVPFTFGSGTKLEIK

SEQ ID NO: 169 - protein, 214 aa, Artificial Sequence
  Trop2#1 LC
DIQMTQSPASLSASVGETVTITCRASGNIHNYLAWYQQKQGKSPQLLVYNAITLADGVPSRFSGSGSGTQYSLKINSLQPEDFGSYYCQHFWSTPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 170 - protein, 450 aa, Artificial Sequence
  Trop2#1 HC (knob)
EVQLQQSGPELLKPGASVKISCKASGYTFTDYTMHWVKQSHGKSLEWIGGIYPNYGDTNYNEKFKDKATLTVDESSSTAYMELRSLTSEDSAVYYCSRKTVLLRLRYFDVWGTGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 171 - protein, 213 aa, Artificial Sequence
  Trop2#8 LC
DIQMTQSPSSLSASLGGKVTITCKASQDINKYIAWYQHKPGKGPRLLIHYTSTLQPGIPSRFSGSGSGRDYSFSISNLEPEDIATYYCLQYDNLWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 172 - protein, 450 aa, Artificial Sequence
  Trop2#8 HC (knob)
QVQLKESGPGLVAPSQSLSITCTVSGLSLSRYSVHWVRQPPGKGLEWLGMIWGGGSTDYNSDFKPRLSISKDNSKSQVFLKMNSLQTDDTAMYYCARKGSYYTNYGAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 173 - protein, 218 aa, Artificial Sequence
  Trop2#9 LC
DVVMTQTPLSLPVSLGDQASISCKSSQSLVHSNGNTFLHWYLQKPGQSPKLLIYKVSNRFSGVPDRFSGSGSGTDFTLKINRVEAEDLGVYFCSQSTHVYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 174 - protein, 448 aa, Artificial Sequence
  Trop2#9 HC (knob)
EVQLQQSGPEPVKPGASVKMSCKASGYTFTDYYMNWVKQSHGKSLEWIGYIYPNNGATGYNQKFKGKATLTVDKSSSTAYMELRSLTSEDSAVYYCAREDSYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 175 - protein, 218 aa, Artificial Sequence
  Trop2#10 LC
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 176 - protein, 447 aa, Artificial Sequence
  Trop2#10 HC (knob)
QIQLQQSGPELVKPGAPVKISCKASGYTFTNYYIHWVKQRPGQGLEWIGYIYPGNGATAYNQKFKGKATLTADNPSSTAYMQLSSLTSEDSAVYFCAREDYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 177 - protein, 218 aa, Artificial Sequence
  Trop2#11 LC
DIVLTQSPPSLAVSLGQRATISCRASESVDSSVNRFMHWYQQKPGQPPKLLIYRASNLESGIPARFSGSGSRTDFTLTINPVEADDVATYYCQQSNEDPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 178 - protein, 446 aa, Artificial Sequence
  Trop2#11 HC (knob)
DVQLQESGPGLVKPSQSLSLTCSVTGYSITSGYYWNWIRQFPGNKLEWMGYISYDGRNNYNPSLKNRISITRDTSENQFFLKLNSVTPEDTATYYCARDTTAYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 179 - protein, 218 aa, Artificial Sequence
  Trop2#12 LC
DIQMTQSPSSLSASVGDRVTITCRASESVSSSVNRFLHWYQQKPGKAPKLLIYRASNLESGVPSRFSGSGSGTDFTLTISSLQPEDFATYYCQQSNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 180 - protein, 446 aa, Artificial Sequence
  Trop2#12 HC (knob)
QVQLQESGPGLVKPSQTLSLTCTVSGYSISSGYYWNWIRQPPGKGLEWIGYISYSGRNLYNPSLKSRVTISRDTSKNQFSLKLSSVTAADTAVYYCARDTTAYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 181 - protein, 218 aa, Artificial Sequence; identical to SEQ ID NO: 179
  Trop2#13 LC

SEQ ID NO: 182 - protein, 446 aa, Artificial Sequence
  Trop2#13 HC (knob)
QVQLQESGPGLVKPSQTLKLTCTVSGYSISSGYYWNWIRQPPGKGLEWIGYISYSGRNLYNPSLKSRVTISRDTSKNQFSLKLSSVTAADTAVYYCARDTTAYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 183 - protein, 218 aa, Artificial Sequence
  Trop2#14 LC
DIQMTQSPSSLSASVGDRVTITCRASESVSSSVNRFLHWYQQKPGKAPKLLIYRASNLESGVPSRFSGKGSGTDFTLTISSLQPEDFATYYCQQSNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 184 - protein, 446 aa, Artificial Sequence; identical to SEQ ID NO: 182
  Trop2#14 HC (knob)

SEQ ID NO: 185 - protein, 218 aa, Artificial Sequence
  Trop2#15 LC
DIQMTQSPSSLSASVGDRVTITCRASESVSSSVNRFLHWYQQKPGKAPKLLIYRASNLESGVPSRFSGSGSGTDFTLTIRSLQPEDFATYYCQQSNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 186 - protein, 446 aa, Artificial Sequence; identical to SEQ ID NO: 182
  Trop2#15 HC (knob)

SEQ ID NO: 187 - protein, 218 aa, Artificial Sequence; identical to SEQ ID NO: 185
  Trop2#16 LC

SEQ ID NO: 188 - protein, 446 aa, Artificial Sequence
  Trop2#16 HC (knob)
QVQLQESGPGLVKPSQTLSLTCTVSGYSISSGYYWNWIRQPPGKGLEWIGYISYSGRNLYNPSLKSRVTISRDTSKNQFSLKLSRVTAADTAVYYCARDTTAYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 189 - protein, 218 aa, Artificial Sequence
  Trop2#17 LC
DIRMTQSPSSLSASVGDRVTITCRASESVSSSVNRFLHWYQQKPGKAPKLLIYRASNLESGVPSRFSGSGSGTDFTLTISSLQPEDFATYYCQQSNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 190 - protein, 446 aa, Artificial Sequence; identical to SEQ ID NO: 182
  Trop2#17 HC (knob)

SEQ ID NO: 191 - protein, 218 aa, Artificial Sequence; identical to SEQ ID NO: 183
  Trop2#18 LC

SEQ ID NO: 192 - protein, 446 aa, Artificial Sequence; identical to SEQ ID NO: 188
  Trop2#18 HC (knob)

SEQ ID NO: 193 - protein, 219 aa, Artificial Sequence
  TNP LC
DVVMTQTPLSLPVSLGDQASISCRSSQSLVHSIGNTYLHWYLQKPGQSPKLLIYKVSNRFSGVPDRFSGSGSGTDFTLKITRVEAEDLGVYFCSQSTHVPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 194 - protein, 450 aa, Artificial Sequence
  TNP HC (hole)
QIQLVQSGPELKKPGETVKISCKTSGYTFTNYGMNWVKQAPGKGLKWVGWINTYTGEPKYADDFKGRFAFSVETSASTAYLQINNLKNEDTATYFCARGIYDGYHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 195 - protein, 450 aa, Artificial Sequence
  TNP HC (knob)
QIQLVQSGPELKKPGETVKISCKTSGYTFTNYGMNWVKQAPGKGLKWVGWINTYTGEPKYADDFKGRFAFSVETSASTAYLQINNLKNEDTATYFCARGIYDGYHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 196 - protein, 220 aa, Artificial Sequence
  CDH17#1 LC
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 197 - protein, 452 aa, Artificial Sequence
  CDH17#1 HC (hole)
QVQLQQSDAELVKPGASVKISCKVSGYTFTDHTIHWMKQRPEQGLEWIGYIYPRDGSTKYNEKFKGKATLTADKSSSTAYMQLNSLTSEDSAVYFCARWGYYYGSSRYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 198 - protein, 220 aa, Artificial Sequence
  CDH17#8 LC
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 199 - protein, 452 aa, Artificial Sequence
  CDH17#8 HC (hole)
QVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 200 - protein, 702 aa, Artificial Sequence
  Trop2#1 full length (knob)
DIQMTQSPASLSASVGETVTITCRASGNIHNYLAWYQQKQGKSPQLLVYNAITLADGVPSRFSGSGSGTQYSLKINSLQPEDFGSYYCQHFWSTPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSEVQLQQSGPELLKPGASVKISCKASGYTFTDYTMHWVKQSHGKSLEWIGGIYPNYGDTNYNEKFKDKATLTVDESSSTAYMELRSLTSEDSAVYYCSRKTVLLRLRYFDVWGTGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 201 - protein, 705 aa, Artificial Sequence
  Trop2#2 full length (knob)
DIQMTQSPASQSASLGDSVTITCLASQTIGTWLAWYQRKPGKSPQLLIYGATSLADGVPSRFSGNGSGTKFSFKISGLQAEDFVSYFCQQLYSTPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSEVQLQQSGPELVKPGASVKISCKASGYTFTDYFMDWVKLSHEKSLEWIGDINPHNGGSDYNQKFKGKATLTVDRSSSTAYMELRSLTSEDSAVYYCAKGPYYYGGGPYWYFDVWGTGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 202 - protein, 696 aa, Artificial Sequence
  Trop2#3 full length (knob)
DILLTQSPAILSVSPGERVSFSCRASQNIGTSIHWYQQRTNGSPRLLIKYASESIYGIPSRFSGSGSGTDFTLNINSVESEDIGDYYCQQSNSWPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQQPGAELVKPGASVKLSCKASGYTFTSYWINWVRQRPGQGLEWIGNIYPGNSITNYNENFKSKATLTADKSSSTAYMQLSSLTSEDSAVYYCTSSSSFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 203 - protein, 696 aa, Artificial Sequence
  Trop2#4 full length (knob)
DILLIQSPAILSVSPGERVSFSCRASQSIGTHIHWFQQRKNGSPRLLIDYASESISGIPSRFSGSGSGTDFILTINSVESEDIADYYCQHSHSWPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQQPGAELVKPGASVKMSCKTSGYTFTIYWINWVKQRPGQGLEWIGNIFPGRGITNYNEKFKTKASLTLDTSSSTVYMQLSSLTFEDSAVYYCSRGSNSDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 204 - protein, 703 aa, Artificial Sequence
  Trop2#5 full length (knob)
DVVMTQTPLSLPVSLGDQASISCRSSQSLVHSHGNIYLHWYLQKPGLSPKLLIFKVSNRFSGVPDRFSGSGSGTDFTLKISRVEAEDLGVYFCSQSTHVWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSEVQLQQSGPDLVKPGASVKMSCKASGFIFTDYYMNWVKQSHGKSLEWIGYIYPNNGATAYNQKFKGKATLTVDKSSSTAYMELRSLTSEDSAVYYCARESDFYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 205 - protein, 695 aa, Artificial Sequence
  Trop2#6 full length (knob)
DILLTQSPAILSVSPGERVSFSCRASQSIGTSIHWFQQRTNGSPRLLIKYASESISGIPSRFSGSGSGTDFTLTINSVESEDIADYYCQQTNTWPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQQSGTELVRPGTSVKMSCKAAGYTFTNYWINWVKQRPGHGLEWIGNIYPGGGYTNYNEKFKGKASLTADTSSSTAYMQLSSLTSEDSAIYYCARGINDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 206 - protein, 700 aa, Artificial Sequence
  Trop2#7 full length (knob)
DIQMTQSSSSFSVSLGDRVTITCKASEDIYNRLAWFQQKPGNAPRLLISGATSLETGVPSRFRGSRSGKDYTLSITSLQTEDVATYYCQQYWSTWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSEVQLQQSGPELVKPGASVKMSCRASGYTFTSYAMHWVKQKPGQGLEWIGYINPYNGGTKYNEKFKGRATLTSDKSSSTAYMELSSLTSEDSAVYYCAREGIYYGAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 207 - protein, 701 aa, Artificial Sequence
  Trop2#8 full length (knob)
DIQMTQSPSSLSASLGGKVTITCKASQDINKYIAWYQHKPGKGPRLLIHYTSTLQPGIPSRFSGSGSGRDYSFSISNLEPEDIATYYCLQYDNLWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLKESGPGLVAPSQSLSITCTVSGLSLSRYSVHWVRQPPGKGLEWLGMIWGGGSTDYNSDFKPRLSISKDNSKSQVFLKMNSLQTDDTAMYYCARKGSYYTNYGAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 208 - protein, 704 aa, Artificial Sequence
  Trop2#9 full length (knob)
DVVMTQTPLSLPVSLGDQASISCKSSQSLVHSNGNTFLHWYLQKPGQSPKLLIYKVSNRFSGVPDRFSGSGSGTDFTLKINRVEAEDLGVYFCSQSTHVYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSEVQLQQSGPEPVKPGASVKMSCKASGYTFTDYYMNWVKQSHGKSLEWIGYIYPNNGATGYNQKFKGKATLTVDKSSSTAYMELRSLTSEDSAVYYCAREDSYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 209 - protein, 703 aa, Artificial Sequence
  Trop2#10 full length (knob)
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQIQLQQSGPELVKPGAPVKISCKASGYTFTNYYIHWVKQRPGQGLEWIGYIYPGNGATAYNQKFKGKATLTADNPSSTAYMQLSSLTSEDSAVYFCAREDYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 210 - protein, 702 aa, Artificial Sequence
  Trop2#11 full length (knob)
DIVLTQSPPSLAVSLGQRATISCRASESVDSSVNRFMHWYQQKPGQPPKLLIYRASNLESGIPARFSGSGSRTDFTLTINPVEADDVATYYCQQSNEDPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSDVQLQESGPGLVKPSQSLSLTCSVTGYSITSGYYWNWIRQFPGNKLEWMGYISYDGRNNYNPSLKNRISITRDTSENQFFLKLNSVTPEDTATYYCARDTTAYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 211 - protein, 702 aa, Artificial Sequence
  Trop2#12 full length (knob)
DIQMTQSPSSLSASVGDRVTITCRASESVSSSVNRFLHWYQQKPGKAPKLLIYRASNLESGVPSRFSGSGSGTDFTLTISSLQPEDFATYYCQQSNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQESGPGLVKPSQTLSLTCTVSGYSISSGYYWNWIRQPPGKGLEWIGYISYSGRNLYNPSLKSRVTISRDTSKNQFSLKLSSVTAADTAVYYCARDTTAYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 212 - protein, 702 aa, Artificial Sequence; identical to SEQ ID NO: 211
  Trop2#13 full length (knob)

SEQ ID NO: 213 - protein, 702 aa, Artificial Sequence
  Trop2#14 full length (knob)
DIQMTQSPSSLSASVGDRVTITCRASESVSSSVNRFLHWYQQKPGKAPKLLIYRASNLESGVPSRFSGKGSGTDFTLTISSLQPEDFATYYCQQSNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQESGPGLVKPSQTLKLTCTVSGYSISSGYYWNWIRQPPGKGLEWIGYISYSGRNLYNPSLKSRVTISRDTSKNQFSLKLSSVTAADTAVYYCARDTTAYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 214 - protein, 702 aa, Artificial Sequence
  Trop2#15 full length (knob)
DIQMTQSPSSLSASVGDRVTITCRASESVSSSVNRFLHWYQQKPGKAPKLLIYRASNLESGVPSRFSGSGSGTDFTLTIRSLQPEDFATYYCQQSNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQESGPGLVKPSQTLKLTCTVSGYSISSGYYWNWIRQPPGKGLEWIGYISYSGRNLYNPSLKSRVTISRDTSKNQFSLKLSSVTAADTAVYYCARDTTAYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 215 - protein, 702 aa, Artificial Sequence
  Trop2#16 full length (knob)
DIQMTQSPSSLSASVGDRVTITCRASESVSSSVNRFLHWYQQKPGKAPKLLIYRASNLESGVPSRFSGSGSGTDFTLTIRSLQPEDFATYYCQQSNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQESGPGLVKPSQTLSLTCTVSGYSISSGYYWNWIRQPPGKGLEWIGYISYSGRNLYNPSLKSRVTISRDTSKNQFSLKLSRVTAADTAVYYCARDTTAYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 216 - protein, 702 aa, Artificial Sequence
  Trop2#17 full length (knob)
DIRMTQSPSSLSASVGDRVTITCRASESVSSSVNRFLHWYQQKPGKAPKLLIYRASNLESGVPSRFSGSGSGTDFTLTISSLQPEDFATYYCQQSNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQESGPGLVKPSQTLKLTCTVSGYSISSGYYWNWIRQPPGKGLEWIGYISYSGRNLYNPSLKSRVTISRDTSKNQFSLKLSSVTAADTAVYYCARDTTAYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 217 - protein, 702 aa, Artificial Sequence
  Trop2#18 full length (knob)
DIQMTQSPSSLSASVGDRVTITCRASESVSSSVNRFLHWYQQKPGKAPKLLIYRASNLESGVPSRFSGKGSGTDFTLTISSLQPEDFATYYCQQSNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQESGPGLVKPSQTLSLTCTVSGYSISSGYYWNWIRQPPGKGLEWIGYISYSGRNLYNPSLKSRVTISRDTSKNQFSLKLSRVTAADTAVYYCARDTTAYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 218 - protein, 707 aa, Artificial Sequence
  TNP full length (hole)
DVVMTQTPLSLPVSLGDQASISCRSSQSLVHSIGNTYLHWYLQKPGQSPKLLIYKVSNRFSGVPDRFSGSGSGTDFTLKITRVEAEDLGVYFCSQSTHVPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQIQLVQSGPELKKPGETVKISCKTSGYTFTNYGMNWVKQAPGKGLKWVGWINTYTGEPKYADDFKGRFAFSVETSASTAYLQINNLKNEDTATYFCARGIYDGYHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 219 - protein, 707 aa, Artificial Sequence
  TNP full length (knob)
DVVMTQTPLSLPVSLGDQASISCRSSQSLVHSIGNTYLHWYLQKPGQSPKLLIYKVSNRFSGVPDRFSGSGSGTDFTLKITRVEAEDLGVYFCSQSTHVPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQIQLVQSGPELKKPGETVKISCKTSGYTFTNYGMNWVKQAPGKGLKWVGWINTYTGEPKYADDFKGRFAFSVETSASTAYLQINNLKNEDTATYFCARGIYDGYHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 220 - protein, 710 aa, Artificial Sequence
  CDH17#1 full length (hole)
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQQSDAELVKPGASVKISCKVSGYTFTDHTIHWMKQRPEQGLEWIGYIYPRDGSTKYNEKFKGKATLTADKSSSTAYMQLNSLTSEDSAVYFCARWGYYYGSSRYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 221 - protein, 710 aa, Artificial Sequence
  CDH17#8 full length (hole)
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 222 - protein, 254 aa, Artificial Sequence
  CD3#1 scFv
EAVVTQEPSLTVSPGGTVTLTCRSSTGAVTTSNYANWVQEKPGQLPRGLIGGTNKRAPWVPARFSGSLLGGKAALTLSGAQPEDEAEYFCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 223 - protein, 254 aa, Artificial Sequence
  CD3#2 scFv
EAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNKWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 224 - protein, 254 aa, Artificial Sequence
  CD3#3 scFv
EAVVTQEPSLTVSPGGTVTLTCRSSTGAVTTSNYANWVQQKPGQLPRGLIGGTNKRAPWVPARFSGSLLGGKAALTLSGAQPEDEAEYYCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 225 - protein, 254 aa, Artificial Sequence
  CD3#4 scFv
EAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 226 - protein, 254 aa, Artificial Sequence
  CD3#5 scFv
EAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGCGTKLTVLGGSEGKSSGSGSESKSTGGSEVQLVESGGGLVQPGGSLKLSCAASGFTFNTYAMNWVRQAPGKCLEWVARIRSKYNNYATYYADSVKDRFTISRDDSKNTAYLQMNNLKTEDTAVYYCVRHGNFGNSYVSWFAYWGQGTLVTVSA

SEQ ID NO: 227 - protein, 254 aa, Artificial Sequence
  CD3#6 scFv
QAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKGRFTISRDDSKNTAYLQMNNLKTEDTAVYYCVRHGNFGNSYVSWFAYWGQGTLVTVSA

SEQ ID NO: 228 - protein, 254 aa, Artificial Sequence
  CD3#7 scFv
QAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGCGTKLTVLGGSEGKSSGSGSESKSTGGSEVQLVESGGGLVQPGGSLKLSCAASGFTFNTYAMNWVRQAPGKCLEWVARIRSKYNNYATYYADSVKGRFTISRDDSKNTAYLQMNNLKTEDTAVYYCVRHGNFGNSYVSWFAYWGQGTLVTVSA

SEQ ID NO: 229 - protein, 254 aa, Artificial Sequence
  CD3#8 scFv
QAVVTQEPSLTVSPGGTVTLTCRSSTGAVTTSNYANWVQQKPGQLPRGLIGGTNKRAPWVPARFSGSLLGGKAALTLSGAQPEDEAEYFCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 230 - protein, 254 aa, Artificial Sequence
  CD3#9 scFv
EAVVTQEPSLTVSPGGTVTLTCRSSTGAVTTSNYANWVQQKPGQLPRGLIGGTNKRAPWVPARFSGSLLGGKAALTLSGAQPEDEAEYFCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 231 - protein, 254 aa, Artificial Sequence
  CD3#10 scFv
EAVVTQEPSLTVSPGGTVTLTCRSSTGAVTTSNYANWVQQKPGQLPRGLIGGTNKRAPGVPARFSGSLLGGKAALTLSGAQPEDEAEYFCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 232 - protein, 254 aa, Artificial Sequence
  CD3#11 scFv
EAVVTQEPSLTVSPGGTVTLTCRSSTGAVTTSNYANWVQQKPGQLPRGLIGGTNKRAPGVPARFSGSLLGGKAALTLSGAQPEDEAEYFCALWYSNKWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 233 - protein, 254 aa, Artificial Sequence
  CD3#12 scFv
EAVVTQEPSLTVSPGGTVTLTCRSSTGAVTTSYYANWVQQKPGKSPRGLIGGTNKRAPGVPARFSGSLLGGKAALTISGAQPEDEADYYCALWYSNHWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFLNSYVSWFAYWGQGTLVTVSA

SEQ ID NO: 234 - protein, 254 aa, Artificial Sequence
  CD3#13 scFv
EAVVTQEPSLTVSPGGTVTLTCRSSTGAVTTSNYANWVQQKPGKSPRGLIGGTNKRAPGVPARFSGSLLGGKAALTISGAQPEDEADYYCALWYSNLWVFGVGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 235 - protein, 254 aa, Artificial Sequence
  CD3#14 scFv
EAVVTQEPSLTVSPGGTVTLTCRSSTGAVTTSNYANWVQQKPGKSPRGLIGGTNIRAPGVPARFSGSLLGGKAALTISGAQPEDEADYYCALWYSNLWVFGYGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 236 - protein, 254 aa, Artificial Sequence
  CD3#15 scFv
EAVVTQEPSLTVSPGGTVTLTCRSSTGAVTTSNYANWVQQKPGKSPRGLIGGTNIRAPGVPARFSGSLLGGKAALTISGAQPEDEAWYFCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFLNSYVSWFAYWGQGTLVTVSA

SEQ ID NO: 237 - protein, 254 aa, Artificial Sequence
  CD3#16 scFv
QAVVTQEPSLTVSPGGTVTLTCISSTGAVTTSNYANWVQQKPGKSPRGLIGGTNIRAPGVPARFSGSLLGGKAALTISGAQPEDEADYYCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 238 - protein, 254 aa, Artificial Sequence
  CD3#17 scFv
QAVVTQEPSLTVSPGGTVTLTCGRSTGAVTTSNYANWVQQKPGKSPRGLIGGTNKRAPGVPARFSGSLLGGKAALTISGAQPEDEADYYCALWYSNHWVFGGGTKLTVLGGSEGKSSGSGSESKSTGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFIDSYVSWFAYWGQGTLVTVSS

SEQ ID NO: 239 - protein, 254 aa, Artificial Sequence
  CD3#18 scFv
QAVVTQEPSLTVSPGGTVTLTCGSSTGAVTTSWYANWVQQKPGKSPRGLIGGTNIRAPGVPARFSGSLLGGKAALTISGAQPEDEADYYCALWYSNHWVFGGGTKLTVLGGSEGKSSGSGSESKSTGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFIDSYVSWFAYWGQGTLVTVSS

SEQ ID NO: 240 - protein, 254 aa, Artificial Sequence
  CD3#19 scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGSEGKSSGSGSESKSTGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFIDSYVSWFAYWGQGTLVTVSS

SEQ ID NO: 241 - protein, 254 aa, Artificial Sequence
  CD3#20 scFv
QAVVTQEPSLTVSPGGTVTLTCVSSTGAVTTSNYANWVQQKPGKSPRGLIGGTNKRAPGVPARFSGSLLGGKAALTISGAQPEDEADYYCALWYSNHWVFGGGTKLTVLGGSEGKSSGSGSESKSTGGSEVQLVESGGGLVQPGGSLRLSCAASGFTFSTYAMNWVRQAPGKGLEWVGRIRSIYNNYATYYADSVKGRFTISRDDSKNTLYLQMNSLRAEDTAVYYCVRHGNFGDSYVSWFAYWGQGTLVTVSS

SEQ ID NO: 242 - protein, 254 aa, Artificial Sequence
  CD3#21 scFv
QAVVTQEPSLTVSPGGTVTLTCGSSTGAVTTSYYANWVKQKPGKSPRGLIGGTNIRAPGVPARFSGSLLGGKAALTISGAQPEDEADYYCALWYSNHWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 243 - protein, 254 aa, Artificial Sequence
  CD3#22 scFv
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGSEGKSSGSGSESKSTGGSEVQLVESGGGLVQPGGSLRLSCAASGFTFSTYAMNWVRQAPGKGLEWVGRIRSIYNNYATYYADIVKGRFTISRDDSKNTLYLQMNSLRAEDTAVYYCVRHGNFIDSYVSWFAYWGQGTLVTVSS

SEQ ID NO: 244 - protein, 254 aa, Artificial Sequence
  CD3#23 scFv
QAVVTQEPSLTVSPGGTVTLTCGSSTGAVTTSWYANWVQQKPGKSPRGLIGGTNKRAPGVPARFSGSLLGGKAALTISGAQPEDEADYYCALWYSNHWVFGGGTKLTVLGGSEGKSSGSGSESKSTGGSEVQLVESGGGLVQPGGSLRLSCAASGFTFSTYAMNWVRQAPGKGLEWVGRIRSKYNNYATYYADIVKGRFTISRDDSKNTLYLQMNSLRAEDTAVYYCVRHGNFIDSYVSWFAYWGQGTLVTVSS

SEQ ID NO: 245 - protein, 254 aa, Artificial Sequence
  CD3#24 scFv
QAVVTQEPSLTVSPGGTVTLTCGSSTGAVTTSYYANWVQQKPGKSPRGLIGGTNKRAPGVPARFSGSLLGGKAALTISGAQPEDEADYYCALWYSNHWVFGGGTKLTVLGGSEGKSSGSGSESKSTGGSEVQLVESGGGLVQPGGSLRLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 246 - protein, 254 aa, Artificial Sequence
  CD3#25 scFv
QAVVTQEPSLTVSPGGTVTLTCGSSTGAVTTSNYANWVQQKPGKSPRGLIGGTNIRAPGVPARFSGSLLGGKAALTISGAQPEDEADYYCALWYSNHWVFGGGTKLTVLGGSEGKSSGSGSESKSTGGSEVQLVESGGGLVQPGGSLRLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 247 - protein, 251 aa, Artificial Sequence
  CD3#26 scFv
DIVMSQSPSSLAVSAGEKVTMFCKSSQSLLNSRTRKNYLAWYQQKPGQSPKLLIYWASTRKSGVPDRFTGSGSGTDFTLTISSVQAEDLAIYYCIQSFILRTFGGGTKLEIKGGSEGKSSGSGSESKSTGGSQVQLQQPGAELGKPGTSVKLSCKASGYTFTSYWMHWVKQRPGQGLEWIGNINADTGSTNYNEKFKNRATLTVDKSSSTAYMQLSTLTSEDSAVYYCTRDGYSFYYFDYWGQGTTLTVSS

SEQ ID NO: 248 - protein, 251 aa, Artificial Sequence
  CD3#27 scFv
DIVMTQSPDSLAVSLGERATINCKSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWMGNINADTGSTNYNEKFKNRVTMTRDTSTSTVYMELSSLRSEDTAVYYCARDGYSFYYFDYWGQGTTVTVSS

SEQ ID NO: 249 - protein, 251 aa, Artificial Sequence
  CD3#28 scFv
DIVMTQSPDSLAVSLGERATIFCKSSQSLLNSRTRKNYLAWYQQKPGQPPKLLIYWASTRKSGVPDRFSGSGSGTDFTLTISSLQAEDVAIYYCIQSFILRTFGQGTKLEIKGGSEGKSSGSGSESKSTGGSQVQLVQSGAEVKKPGASVKVSCKASGYTFTSYWMHWVRQAPGQGLEWMGNINASTGSTNYNQKFKGRVTMTVDTSTSTVYMELSSLRSEDTAVYYCTRDAYSFYYFDYWGQGTTLTVSS

SEQ ID NO: 250 - protein, 251 aa, Artificial Sequence
  CD3#29 scFv
DIVMTQSPDSLAVSLGERATIFCKSSQSLLNSRTRKNYLAWYQQKPGQPPKLLIYWASTRKSGVPDRFSGSGSGTDFTLTISSLQAEDVAIYYCIQSFILRTFGQGTKLEIKGGSEGKSSGSGSESKSTGGSQVQLVQSGAEVKKPGASVKVSCKASGYTFTSYWMHWVRQAPGQGLEWMGNINASTGSTSYAEKFKGRVTMTVDTSTSTVYMELSSLRSEDTAVYYCTRDGYSFYYFDYWGQGTTLTVSS

SEQ ID NO: 251 - protein, 251 aa, Artificial Sequence
  CD3#30 scFv
DIVMTQSPDSLAVSLGERATIFCKSSQSLLNSRTRKNYLAWYQQKPGQPPKLLIYWASTRKSGVPDRFSGSGSGTDFTLTISSLQAEDVAIYYCIQSFILRTFGQGTKLEIKGGSEGKSSGSGSESKSTGGSQVQLVQSGAEVKKPGASVKVSCKASGYTFTSYWMHWVRQAPGQGLEWMGNINASTGSTNYAQKFQGRVTMTVDTSTSTVYMELSSLRSEDTAVYYCTRDGYSFYYFDYWGQGTTLTVSS

SEQ ID NO: 252 - protein, 251 aa, Artificial Sequence
  CD3#31 scFv
DIVMTQSPDSLAVSLGERATIFCKSSQSLLNARTRKNYLAWYQQKPGQPPKLLIYWASTRKSGVPDRFSGSGSGTDFTLTISSLQAEDVAIYYCIQSFILRTFGQGTKLEIKGGSEGKSSGSGSESKSTGGSQVQLVQSGAEVKKPGASVKVSCKASGYTFTSYWMHWVRQAPGQGLEWMGNINASTGSTNYAQKFKGRVTMTVDTSTSTVYMELSSLRSEDTAVYYCTRDGYSFYYFDYWGQGTTLTVSS

SEQ ID NO: 253 - protein, 251 aa, Artificial Sequence
  CD3#32 scFv
DIVMTQSPDSLAVSLGERATIFCKSSQSLLNARTRKNYLAWYQQKPGQPPKLLIYWASTRKSGVPDRFSGSGSGTDFTLTISSLQAEDVAIYYCIQSFILRTFGQGTKLEIKGGSEGKSSGSGSESKSTGGSQVQLVQSGAEVKKPGASVKVSCKASGYTFTSYWMHWVRQAPGQGLEWMGNINASTGSTNYAQKFQGRVTMTVDTSTSTVYMELSSLRSEDTAVYYCTRDAYSFYYFDYWGQGTTLTVSS

SEQ ID NO: 254 - protein, 251 aa, Artificial Sequence
  CD3#33 scFv
DIVMTQSPDSLAVSLGERATMFCKSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINASTGSTSYNQKFKGRVTMTRDTSTSTVYMELSSLRSEDTAVYYCARDGYSFYYFDYWGQGTTVTVSS

SEQ ID NO: 255 - protein, 251 aa, Artificial Sequence
  CD3#34 scFv
DIVMTQSPDSLAVSLGERATMFCKSSQSLLNARTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINASTGSTNYNQKFKGRVTMTRDTSTSTVYMELSSLRSEDTAVYYCARDGYSFYYFDYWGQGTTVTVSS

SEQ ID NO: 256 - protein, 251 aa, Artificial Sequence
  CD3#35 scFv
DIVMTQSPDSLAVSLGERATMFCKSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINASTGSTSYNQKFQNRVTMTRDTSTSTVYMELSSLRSEDTAVYYCARDGYSFYYFDYWGQGTTVTVSS

SEQ ID NO: 257 - protein, 251 aa, Artificial Sequence
  CD3#36 scFv
DIVMTQSPDSLAVSLGERATMFCKSSQSLLNARTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINASTGSTNYNQKFQNRVTMTRDTSTSTVYMELSSLRSEDTAVYYCARDGYSFYYFDYWGQGTTVTVSS

SEQ ID NO: 258 - protein, 251 aa, Artificial Sequence
  CD3#37 scFv
DIVMTQSPDSLAVSLGERATMFCKSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINASTGSTSYAQKFKGRVTMTRDTSTSTVYMELSSLRSEDTAVYYCARDGYSFYYFDYWGQGTTVTVSS

SEQ ID NO: 259 - protein, 251 aa, Artificial Sequence
  CD3#38 scFv
DIVMTQSPDSLAVSLGERATINCRSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWMGNINADTGSTKYNQKFKGRVTMTRDTSTSTVYMELSSLRSEDTAVYYCARDGYSFYYFDYWGQGTTVTVSS

SEQ ID NO: 260 - protein, 251 aa, Artificial Sequence
  CD3#39 scFv
DIVMTQSPDSLAVSLGERATINCKSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWMGNINADTGSTNYNQKFQGRVTMTRDTSTSTVYMELSSLRSEDTAVYYCARDAYSFYYFDYWGQGTTVTVSS

SEQ ID NO: 261 - protein, 251 aa, Artificial Sequence
  CD3#40 scFv
DIVMTQSPDSLAVSLGERATIFCRSSQSLLNSRTRKNYLAWYQQKPGQPPKLLIYWASTRKSGVPDRFSGSGSGTDFTLTISSLQAEDVAIYYCIQSFILRTFGQGTKLEIKGGSEGKSSGSGSESKSTGGSQVQLVQSGAEVKKPGASVKVSCKASGYTFTSYWMHWVRQAPGQGLEWMGNINADTGSTKYNQKFKGRVTMTVDTSTSTVYMELSSLRSEDTAVYYCTRDGYSFYYFDYWGQGTTLTVSS

SEQ ID NO: 262 - protein, 251 aa, Artificial Sequence
  CD3#41 scFv
DIVMTQSPDSLAVSLGERATMFCRSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINADTGSTKYNQKFKGRVTMTRDTSTSTVYMELSSLRSEDTAVYYCARDGYSFYYFDYWGQGTTVTVSS

SEQ ID NO: 263 - protein, 251 aa, Artificial Sequence
  CD3#42 scFv
DIVMTQSPDSLAVSLGERATIFCKSSQSLLNSRTRKNYLAWYQQKPGQPPKLLIYWASTRKSGVPDRFSGSGSGTDFTLTISSLQAEDVAIYYCIQSFILRTFGQGTKLEIKGGSEGKSSGSGSESKSTGGSQVQLVQSGAEVKKPGASVKVSCKASGYTFTSYWMHWVRQAPGQGLEWMGNINADTGSTNYNQKFQGRVTMTVDTSTSTVYMELSSLRSEDTAVYYCTRDAYSFYYFDYWGQGTTLTVSS

SEQ ID NO: 264 - protein, 251 aa, Artificial Sequence
  CD3#43 scFv
DIVMTQSPDSLAVSLGERATMFCKSSQSLLNSRTRKNYLAWYQQKPGQPPKLLIYWASTRKSGVPDRFSGSGSGTDFTLTISSLQAEDVAVYYCIQSFILRTFGQGTKLEIKGGSEGKSSGSGSESKSTGGSQVQLVQSGAEVKKPGASVKVSCKASGYTFTSYWMHWVRQAPGQGLEWIGNINADTGSTNYNQKFQGRVTMTRDTSTSTVYMELSSLRSEDTAVYYCARDAYSFYYFDYWGQGTTVTVSS

SEQ ID NO: 265 - protein, 20 aa, Artificial Sequence
  Linker, e.g. between VH and VL within CD3 scFv
GGSEGKSSGSGSESKSTGGS

SEQ ID NO: 266 - protein, 38 aa, Artificial Sequence
  Linker, e.g. Between LC and HC
GGGGSEGKSSGSGSESKSTEGKSSGSGSESKSTGGGGS

SEQ ID NO: 267 - protein, 984 aa, Artificial Sequence
  CDH17#1(hole) / CD3#1 full length
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQQSDAELVKPGASVKISCKVSGYTFTDHTIHWMKQRPEQGLEWIGYIYPRDGSTKYNEKFKGKATLTADKSSSTAYMQLNSLTSEDSAVYFCARWGYYYGSSRYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGGGGGSGGGGSGGGGSGGGGSEAVVTQEPSLTVSPGGTVTLTCRSSTGAVTTSNYANWVQEKPGQLPRGLIGGTNKRAPWVPARFSGSLLGGKAALTLSGAQPEDEAEYFCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 268 - protein, 984 aa, Artificial Sequence; identical to SEQ ID NO: 267
  CDH17#1(hole) / CD3#2 full length

SEQ ID NO: 269 - protein, 984 aa, Artificial Sequence; identical to SEQ ID NO: 267
  CDH17#1(hole) / CD3#3 full length

SEQ ID NO: 270 - protein, 984 aa, Artificial Sequence
  CDH17#8 (hole) / CD3#1 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGGGGGSGGGGSGGGGSGGGGSEAVVTQEPSLTVSPGGTVTLTCRSSTGAVTTSNYANWVQQKPGQLPRGLIGGTNKRAPWVPARFSGSLLGGKAALTLSGAQPEDEAEYYCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 271 - protein, 984 aa, Artificial Sequence
  CDH17#8 (hole) / CD3#2 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGGGGGSGGGGSGGGGSGGGGSEAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNKWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 272 - protein, 984 aa, Artificial Sequence; identical to SEQ ID NO: 270
  CDH17#8 (hole) / CD3#3 full length

SEQ ID NO: 273 - protein, 4 aa, Artificial Sequence
  4aa linker
GGGS

SEQ ID NO: 274 - protein, 6 aa, Artificial Sequence
  6aa linker
GGSGGS

SEQ ID NO: 275 - protein, 20 aa, Artificial Sequence
  20aa linker; e.g. between Fc and CD3 scFv
GGGGSGGGGSGGGGSGGGGS

SEQ ID NO: 276 - protein, 10 aa, Artificial Sequence
  Trop2#1 HCDR1 (CCG)
GYTFTDYTMH

SEQ ID NO: 277 - protein, 10 aa, Artificial Sequence
  Trop2#8 HCDR1 (CCG)
GLSLSRYSVH

SEQ ID NO: 278 - protein, 11 aa, Artificial Sequence
  Trop2#11 HCDR1 (CCG)
GYSITSGYYWN

SEQ ID NO: 279 - protein, 11 aa, Artificial Sequence
  Trop2#12 to #18 HCDR1 (CCG)
GYSISSGYYWN

SEQ ID NO: 280 - protein, 10 aa, Artificial Sequence
  Trop2#9 HCDR1 (CCG)
GYTFTDYYMN

SEQ ID NO: 281 - protein, 10 aa, Artificial Sequence
  Trop2#10 HCDR1 (CCG)
GYTFTNYYIH

SEQ ID NO: 282 - protein, 10 aa, Artificial Sequence
  CDH17#1 HCDR1 (CCG)
GYTFTDHTIH

SEQ ID NO: 283 - protein, 10 aa, Artificial Sequence
  CDH17#8 HCDR1 (CCG)
GYTFSDHTIH

SEQ ID NO: 284 - protein, 10 aa, Artificial Sequence
  CD3#1 to #15, #20, #23, #24 HCDR1 (CCG)
GFTFNTYAMN

SEQ ID NO: 285 - protein, 10 aa, Artificial Sequence
  CD3#16 to #19, #21, #22 HCDR1 (CCG)
GFTFSTYAMN

SEQ ID NO: 286 - protein, 10 aa, Artificial Sequence
  CDH17#25 to #42 HCDR1 (CCG)
GYTFTSYWMH

SEQ ID NO: 287 - protein, 7 aa, Artificial Sequence
  Trop2#1 and #9 HCDR1 (Chothia)
GYTFTDY

SEQ ID NO: 288 - protein, 6 aa, Artificial Sequence
  Trop2#1 HCDR2 (Chothia)
YPNYGD

SEQ ID NO: 289 - protein, 7 aa, Artificial Sequence
  Trop2#8 HCDR1 (Chothia)
GLSLSRY

SEQ ID NO: 290 - protein, 5 aa, Artificial Sequence
  Trop2#8 HCDR2 (Chothia)
WGGGS

SEQ ID NO: 291 - protein, 8 aa, Artificial Sequence
  Trop2#11 HCDR1 (Chothia)
GYSITSGY

SEQ ID NO: 292 - protein, 5 aa, Artificial Sequence
  Trop2#11 HCDR2 (Chothia)
SYDGR

SEQ ID NO: 293 - protein, 8 aa, Artificial Sequence
  Trop2#12 to #18 HCDR1 (Chothia)
GYSISSGY

SEQ ID NO: 294 - protein, 5 aa, Artificial Sequence
  Trop2#12 to #18 HCDR2 (Chothia)
SYSGR

SEQ ID NO: 295 - protein, 6 aa, Artificial Sequence
  Trop2#9 HCDR2 (Chothia)
YPNNGA

SEQ ID NO: 296 - protein, 7 aa, Artificial Sequence
  Trop2#10 HCDR1 (Chothia)
GYTFTNY

SEQ ID NO: 297 - protein, 6 aa, Artificial Sequence
  Trop2#10 HCDR2 (Chothia)
YPGNGA

SEQ ID NO: 298 - protein, 7 aa, Artificial Sequence
  CDH17#1 HCDR1 (Chothia)
GYTFTDH

SEQ ID NO: 299 - protein, 6 aa, Artificial Sequence
  CDH17#1 HCDR2 (Chothia)
YPRDGS

SEQ ID NO: 300 - protein, 7 aa, Artificial Sequence
  CDH17#8 HCDR1 (Chothia)
GYTFSDH

SEQ ID NO: 301 - protein, 6 aa, Artificial Sequence
  CDH17#8 HCDR2 (Chothia)
YPRLGS

SEQ ID NO: 302 - protein, 7 aa, Artificial Sequence
  CD3#1 to #15, #20, #23, #24 HCDR1 (Chothia)
GFTFNTY

SEQ ID NO: 303 - protein, 8 aa, Artificial Sequence
  CD3#1 to #18, #20, #22, #23, #24 HCDR1 (Chothia)
RSKYNNYA

SEQ ID NO: 304 - protein, 7 aa, Artificial Sequence
  CD3#16 to #19, #21, #22 HCDR1 (Chothia)
GFTFSTY

SEQ ID NO: 305 - protein, 8 aa, Artificial Sequence
  CD3#19, #21, HCDR1 (Chothia)
RSIYNNYA

SEQ ID NO: 306 - protein, 7 aa, Artificial Sequence
  CD3#25 to #42 HCDR1 (Chothia)
GYTFTSY

SEQ ID NO: 307 - protein, 6 aa, Artificial Sequence
  CD3#25, #26, #37 to #42 HCDR1 (Chothia)
NADTGS

SEQ ID NO: 308 - protein, 6 aa, Artificial Sequence
  CD3#27 to #36 HCDR1 (Chothia)
NASTGS

SEQ ID NO: 309 - protein, 8 aa, Artificial Sequence
  Trop2#1 HCDR1 (IMGT)
GYTFTDYT

SEQ ID NO: 310 - protein, 8 aa, Artificial Sequence
  Trop2#1 HCDR2 (IMGT)
IYPNYGDT

SEQ ID NO: 311 - protein, 14 aa, Artificial Sequence
  Trop2#1 HCDR3 (IMGT)
SRKTVLLRLRYFDV

SEQ ID NO: 312 - protein, 6 aa, Artificial Sequence
  Trop2#1 LCDR1 (IMGT)
GNIHNY

SEQ ID NO: 313 - protein, 6 aa, Artificial Sequence
  Trop2#1 LCDR1 (IMGT)
GNIHNY

SEQ ID NO: 314 - protein, 8 aa, Artificial Sequence
  Trop2#8 HCDR1 (IMGT)
GLSLSRYS

SEQ ID NO: 315 - protein, 7 aa, Artificial Sequence
  Trop2#8 HCDR2 (IMGT)
IWGGGST

SEQ ID NO: 316 - protein, 15 aa, Artificial Sequence
  Trop2#8 HCDR3 (IMGT)
ARKGSYYTNYGAMDY

SEQ ID NO: 317 - protein, 6 aa, Artificial Sequence
  Trop2#8 LCDR1 (IMGT)
QDINKY

SEQ ID NO: 318 - protein, 6 aa, Artificial Sequence
  Trop2#8 LCDR1 (IMGT)
QDINKY

SEQ ID NO: 319 - protein, 9 aa, Artificial Sequence
  Trop2#11 HCDR1 (IMGT)
GYSITSGYY

SEQ ID NO: 320 - protein, 7 aa, Artificial Sequence
  Trop2#11HCDR2 (IMGT)
ISYDGRN

SEQ ID NO: 321 - protein, 10 aa, Artificial Sequence
  Trop2#11 to #18 HCDR3 (IMGT)
ARDTTAYFDY

SEQ ID NO: 322 - protein, 10 aa, Artificial Sequence
  Trop2#11 LCDR1 (IMGT)
ESVDSSVNRF

SEQ ID NO: 323 - protein, 10 aa, Artificial Sequence
  Trop2#11 LCDR1 (IMGT)
ESVDSSVNRF

SEQ ID NO: 324 - protein, 9 aa, Artificial Sequence
  Trop2#12 to #18 HCDR1 (IMGT)
GYSISSGYY

SEQ ID NO: 325 - protein, 7 aa, Artificial Sequence
  Trop2#12 to #18 HCDR2 (IMGT)
ISYSGRN

SEQ ID NO: 326 - protein, 10 aa, Artificial Sequence
  Trop2#12 to #18 LCDR1 (IMGT)
ESVSSSVNRF

SEQ ID NO: 327 - protein, 8 aa, Artificial Sequence
  Trop2#9 HCDR1 (IMGT)
GYTFTDYY

SEQ ID NO: 328 - protein, 8 aa, Artificial Sequence
  Trop2#9 HCDR2 (IMGT)
IYPNNGAT

SEQ ID NO: 329 - protein, 12 aa, Artificial Sequence
  Trop2#9 HCDR3 (IMGT)
AREDSYYYAMDY

SEQ ID NO: 330 - protein, 11 aa, Artificial Sequence
  Trop2#9 LCDR1 (IMGT)
QSLVHSNGNTF

SEQ ID NO: 331 - protein, 11 aa, Artificial Sequence
  Trop2#9 LCDR1 (IMGT)
QSLVHSNGNTF

SEQ ID NO: 332 - protein, 8 aa, Artificial Sequence
  Trop2#10 HCDR1 (IMGT)
GYTFTNYY

SEQ ID NO: 333 - protein, 8 aa, Artificial Sequence
  Trop2#10 HCDR2 (IMGT)
IYPGNGAT

SEQ ID NO: 334 - protein, 11 aa, Artificial Sequence
  Trop2#10 HCDR3 (IMGT)
AREDYYYAMDY

SEQ ID NO: 335 - protein, 11 aa, Artificial Sequence
  Trop2#10 LCDR1 (IMGT)
QSLVHSNGNTY

SEQ ID NO: 336 - protein, 8 aa, Artificial Sequence
  CDH17#1 HCDR1 (IMGT)
GYTFTDHT

SEQ ID NO: 337 - protein, 8 aa, Artificial Sequence
  CDH17#1 HCDR2 (IMGT)
IYPRDGST

SEQ ID NO: 338 - protein, 16 aa, Artificial Sequence
  CDH17#1 and #8 HCDR3 (IMGT)
ARWGYYYGSSRYYFDY

SEQ ID NO: 339 - protein, 12 aa, Artificial Sequence
  CDH17#1 LCDR1 (IMGT)
QSLLYSSNQKNY

SEQ ID NO: 340 - protein, 12 aa, Artificial Sequence
  CDH17#1 LCDR1 (IMGT)
QSLLYSSNQKNY

SEQ ID NO: 341 - protein, 8 aa, Artificial Sequence
  CDH17#8 HCDR1 (IMGT)
GYTFSDHT

SEQ ID NO: 342 - protein, 8 aa, Artificial Sequence
  CDH17#8 HCDR2 (IMGT)
IYPRLGST

SEQ ID NO: 343 - protein, 12 aa, Artificial Sequence
  CDH17#8 LCDR1 (IMGT)
QSVLYSSNQKQY

SEQ ID NO: 344 - protein, 12 aa, Artificial Sequence
  CDH17#8 LCDR1 (IMGT)
QSVLYSSNQKQY

SEQ ID NO: 345 - protein, 8 aa, Artificial Sequence
  CD3#1 to # 15, #20, #23, #24 HCDR1 (IMGT)
GFTFNTYA

SEQ ID NO: 346 - protein, 10 aa, Artificial Sequence
  CD3#1 to # 18, #20, #22, #23, #24 HCDR2 (IMGT)
IRSKYNNYAT

SEQ ID NO: 347 - protein, 16 aa, Artificial Sequence
  CD3#1 to # 10, #12, #13, #15, #20, #23, #24 HCDR3 (IMGT)
VRHGNFGNSYVSWFAY

SEQ ID NO: 348 - protein, 9 aa, Artificial Sequence
  CD3#1 to # 10, #12 to #16, #18, #19, #21, #24 LCDR1 (IMGT)
TGAVTTSNY

SEQ ID NO: 349 - protein, 9 aa, Artificial Sequence
  CD3#1 to # 10, #12 to #16, #18, #19, #21, #24 LCDR1 (IMGT)
TGAVTTSNY

SEQ ID NO: 350 - protein, 16 aa, Artificial Sequence
  CD3#11, #14 HCDR3 (IMGT)
VRHGNFLNSYVSWFAY

SEQ ID NO: 351 - protein, 9 aa, Artificial Sequence
  CD3#11, #20, #23 LCDR1 (IMGT)
TGAVTTSYY

SEQ ID NO: 352 - protein, 8 aa, Artificial Sequence
  CD3#16 to # 19, #21, #22 HCDR1 (IMGT)
GFTFSTYA

SEQ ID NO: 353 - protein, 16 aa, Artificial Sequence
  CD3#16 to # 18, #21, #22, HCDR2 (IMGT)
VRHGNFIDSYVSWFAY

SEQ ID NO: 354 - protein, 9 aa, Artificial Sequence
  CD3#17 and # 22
TGAVTTSWY

SEQ ID NO: 355 - protein, 10 aa, Artificial Sequence
  CD3#19 and #21 HCDR2 (IMGT)
IRSIYNNYAT

SEQ ID NO: 356 - protein, 16 aa, Artificial Sequence
  CD3#19 HCDR3 (IMGT)
VRHGNFGDSYVSWFAY

SEQ ID NO: 357 - protein, 8 aa, Artificial Sequence
  CD3#25 to #42 HCDR1 (IMGT)
GYTFTSYW

SEQ ID NO: 358 - protein, 8 aa, Artificial Sequence
  CD3#25, #26, #37 to #42 HCDR2 (IMGT)
INADTGST

SEQ ID NO: 359 - protein, 12 aa, Artificial Sequence
  CD3#25, #28 to #30, #39 HCDR3 (IMGT)
TRDGYSFYYFDY

SEQ ID NO: 360 - protein, 12 aa, Artificial Sequence
  CD3#25 to #29, #32, #34, #36 to #42 LCDR1 (IMGT)
QSLLNSRTRKNY

SEQ ID NO: 361 - protein, 12 aa, Artificial Sequence
  CD3#26, #32 to #37, #40 HCDR3 (IMGT)
ARDGYSFYYFDY

SEQ ID NO: 362 - protein, 8 aa, Artificial Sequence
  CD3#27 to #36 HCDR2 (IMGT)
INASTGST

SEQ ID NO: 363 - protein, 12 aa, Artificial Sequence
  CD3#27, #31, #41 HCDR3 (IMGT)
TRDAYSFYYFDY

SEQ ID NO: 364 - protein, 12 aa, Artificial Sequence
  CD3#30, #31, #33, #35 LCDR1 (IMGT)
QSLLNARTRKNY

SEQ ID NO: 365 - protein, 12 aa, Artificial Sequence
  CD3#38, #42 HCDR3 (IMGT)
ARDAYSFYYFDY

SEQ ID NO: 366 - protein, 13 aa, Artificial Sequence
  Trop2#1 HCDR1 (North)
KASGYTFTDYTMH

SEQ ID NO: 367 - protein, 10 aa, Artificial Sequence
  Trop2#1 HCDR2 (North)
GIYPNYGDTN

SEQ ID NO: 368 - protein, 14 aa, Artificial Sequence
  Trop2#1 HCDR3 (North)
SRKTVLLRLRYFDV

SEQ ID NO: 369 - protein, 8 aa, Artificial Sequence
  Trop2#1 LCDR2 (North
YNAITLAD

SEQ ID NO: 370 - protein, 13 aa, Artificial Sequence
  Trop2#8 HCDR1 (North)
TVSGLSLSRYSVH

SEQ ID NO: 371 - protein, 9 aa, Artificial Sequence
  Trop2#8 HCDR2 (North)
MIWGGGSTD

SEQ ID NO: 372 - protein, 15 aa, Artificial Sequence
  Trop2#8 HCDR3 (North)
ARKGSYYTNYGAMDY

SEQ ID NO: 373 - protein, 8 aa, Artificial Sequence
  Trop2#8 LCDR2 (North)
HYTSTLQP

SEQ ID NO: 374 - protein, 14 aa, Artificial Sequence
  Trop2#11 HCDR1 (North)
SVTGYSITSGYYWN

SEQ ID NO: 375 - protein, 9 aa, Artificial Sequence
  Trop2#11HCDR2 (North)
YISYDGRNN

SEQ ID NO: 376 - protein, 10 aa, Artificial Sequence
  Trop2#11 to #18 HCDR3 (North)
ARDTTAYFDY

SEQ ID NO: 377 - protein, 8 aa, Artificial Sequence
  Trop2#11 to #18 LCDR2 (North)
YRASNLES

SEQ ID NO: 378 - protein, 14 aa, Artificial Sequence
  Trop2#12 to #18 HCDR1 (North)
TVSGYSISSGYYWN

SEQ ID NO: 379 - protein, 9 aa, Artificial Sequence
  Trop2#12 to #18 HCDR2 (North)
YISYSGRNL

SEQ ID NO: 380 - protein, 13 aa, Artificial Sequence
  Trop2#9 HCDR1 (North)
KASGYTFTDYYMN

SEQ ID NO: 381 - protein, 10 aa, Artificial Sequence
  Trop2#9 HCDR2 (North)
YIYPNNGATG

SEQ ID NO: 382 - protein, 12 aa, Artificial Sequence
  Trop2#9 HCDR3 (North)
AREDSYYYAMDY

SEQ ID NO: 383 - protein, 8 aa, Artificial Sequence
  Trop2#9 and #10 LCDR2 (North)
YKVSNRFS

SEQ ID NO: 384 - protein, 13 aa, Artificial Sequence
  Trop2#10 HCDR1 (North)
KASGYTFTNYYIH

SEQ ID NO: 385 - protein, 10 aa, Artificial Sequence
  Trop2#10
YIYPGNGATA

SEQ ID NO: 386 - protein, 11 aa, Artificial Sequence
  Trop2#10 HCDR3 (North)
AREDYYYAMDY

SEQ ID NO: 387 - protein, 13 aa, Artificial Sequence
  CDH17#1 HCDR1 (North)
KVSGYTFTDHTIH

SEQ ID NO: 388 - protein, 10 aa, Artificial Sequence
  CDH17#1 HCDR2 (North)
YIYPRDGSTK

SEQ ID NO: 389 - protein, 16 aa, Artificial Sequence
  CDH17#1 and #8 HCDR3 (North)
ARWGYYYGSSRYYFDY

SEQ ID NO: 390 - protein, 8 aa, Artificial Sequence
  CDH17#1 LCDR2 (North)
YWASTRES

SEQ ID NO: 391 - protein, 13 aa, Artificial Sequence
  CDH17#8 HCDR1 (North)
KASGYTFSDHTIH

SEQ ID NO: 392 - protein, 10 aa, Artificial Sequence
  CDH17#8 HCDR2 (North)
YIYPRLGSTK

SEQ ID NO: 393 - protein, 8 aa, Artificial Sequence
  CDH17#8 LCDR2 (North)
YGASTRET

SEQ ID NO: 394 - protein, 13 aa, Artificial Sequence
  CD3#1 to #15, #20, #23, #24 HCDR1 (North)
AASGFTFNTYAMN

SEQ ID NO: 395 - protein, 12 aa, Artificial Sequence
  CD3#1 to #18, #20, #22, #23, #24 HCDR2 (North)
RIRSKYNNYATY

SEQ ID NO: 396 - protein, 16 aa, Artificial Sequence
  CD3#1 to #10, #12, #13, #15, #20, #23, #24 HCDR3 (North)
VRHGNFGNSYVSWFAY

SEQ ID NO: 397 - protein, 8 aa, Artificial Sequence
  CD3#1 to #12, #16, #18, #19, #21, #22, #23 LCDR2 (North)
GGTNKRAP

SEQ ID NO: 398 - protein, 16 aa, Artificial Sequence
  CD3#11 and #14 HCDR3 (North)
VRHGNFLNSYVSWFAY

SEQ ID NO: 399 - protein, 8 aa, Artificial Sequence
  CD3#13 to #15, #17, #20, #24 LCDR2 (North)
GGTNIRAP

SEQ ID NO: 400 - protein, 13 aa, Artificial Sequence
  CD3#16 to #18, #21, #22 HCDR1 (North)
AASGFTFSTYAMN

SEQ ID NO: 401 - protein, 16 aa, Artificial Sequence
  CD3#16 to #18, #21, #22 HCDR3 (North)
VRHGNFIDSYVSWFAY

SEQ ID NO: 402 - protein, 12 aa, Artificial Sequence
  CD3#19 and #21 HCDR2 (North)
RIRSIYNNYATY

SEQ ID NO: 403 - protein, 16 aa, Artificial Sequence
  CD3#19 HCDR3 (North)
VRHGNFGDSYVSWFAY

SEQ ID NO: 404 - protein, 13 aa, Artificial Sequence
  CD3#25 to #42 HCDR1 (North)
KASGYTFTSYWMH

SEQ ID NO: 405 - protein, 10 aa, Artificial Sequence
  CD3#25, #26, #38, # 41, #42 HCDR2 (North)
NINADTGSTN

SEQ ID NO: 406 - protein, 12 aa, Artificial Sequence
  CD3#25, #28 to #30, #39 HCDR3(North)
TRDGYSFYYFDY

SEQ ID NO: 407 - protein, 8 aa, Artificial Sequence
  CD3#25 to # 42 LCDR2 (North)
YWASTRKS

SEQ ID NO: 408 - protein, 12 aa, Artificial Sequence
  CD3#26, #32 to #37, #40 HCDR3(North)
ARDGYSFYYFDY

SEQ ID NO: 409 - protein, 10 aa, Artificial Sequence
  CD3#27, #29 to #31, #33, # 35 HCDR2 (North)
NINASTGSTN

SEQ ID NO: 410 - protein, 12 aa, Artificial Sequence
  CD3#27, #31, #41 HCDR3(North)
TRDAYSFYYFDY

SEQ ID NO: 411 - protein, 10 aa, Artificial Sequence
  CD3#28, #32, #34, #36 HCDR2 (North)
NINASTGSTS

SEQ ID NO: 412 - protein, 10 aa, Artificial Sequence
  CD3#37, #39, #40 HCDR2 (North)
NINADTGSTK

SEQ ID NO: 413 - protein, 12 aa, Artificial Sequence
  CD3#38 #42 HCDR3(North)
ARDAYSFYYFDY

SEQ ID NO: 414 - protein, 330 aa, Artificial Sequence
  IgG1 wildtype HC
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 415 - protein, 329 aa, Artificial Sequence
  IgG1 KO HC
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 416 - protein, 327 aa, Artificial Sequence
  IgG4 Pro wild type HC
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 417 - protein, 329 aa, Artificial Sequence
  IgG1 FcRnmut
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 418 - protein, 107 aa, Artificial Sequence [sequence omitted]

SEQ ID NO: 419 - protein, 323 aa, Artificial Sequence
  human Trop2
MARGPGLAPPPLRLPLLLLVLAAVTGHTAAQDNCTCPTNKMTVCSPDGPGGRCQCRALGSGMAVDCSTLTSKCLLLKARMSAPKNARTLVRPSEHALVDNDGLYDPDCDPEGRFKARQCNQTSVCWCVNSVGVRRTDKGDLSLRCDELVRTHHILIDLRHRPTAGAFNHSDLDAELRRLFRERYRLHPKFVAAVHYEQPTIQIELRQNTSQKAAGDVDIGDAAYYFERDIKGESLFQGRGGLDLRVRGEPLQVERTLIYYLDEIPPKFSMKRLTAGLIAVIVVVVVALVAGMAVLVITNRRKSGKYKKVEIKELGELRKEPSL

SEQ ID NO: 420 - protein, 832 aa, Artificial Sequence
  human CDH17
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGKPFLYVNATDLDDPATPNGQLYYQIVIQLPMINNVMYFQINNKTGAISLTREGSQELNPAKNPSYNLVISVKDMGGQSENSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDYTGLFFCHPLSAPGSLIFEATDDDQHLFRGPHFTFSLGSGSLQNDWEVSKINGTHARLSTRHTEFEEREYVVLIRINDGGRPPLEGIVSLPVTFCSCVEGSCFRPAGHQTGIPTVGMAVGILLTTLLVIGIILAVVFIRIKKDKGKDNVESAQASEVKPLRS

SEQ ID NO: 421 - protein, 171 aa, Artificial Sequence
  human CD3 delta chain
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 422 - protein, 207 aa, Artificial Sequence
  human CD3 epsilon chain
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 423 - protein, 182 aa, Artificial Sequence
  human CD3 gamma chain
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 424 - protein, 164 aa, Artificial Sequence
  human CD3 zeta chain
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 425 - protein, 984 aa, Artificial Sequence
  CDH17#8 (hole) / CD3#5 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGGGGGSGGGGSGGGGSGGGGSQAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKGRFTISRDDSKNTAYLQMNNLKTEDTAVYYCVRHGNFGNSYVSWFAYWGQGTLVTVSA

SEQ ID NO: 426 - protein, 984 aa, Artificial Sequence
  CDH17#8 (hole) / CD3#6 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGGGGGSGGGGSGGGGSGGGGSQAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGCGTKLTVLGGSEGKSSGSGSESKSTGGSEVQLVESGGGLVQPGGSLKLSCAASGFTFNTYAMNWVRQAPGKCLEWVARIRSKYNNYATYYADSVKGRFTISRDDSKNTAYLQMNNLKTEDTAVYYCVRHGNFGNSYVSWFAYWGQGTLVTVSA

SEQ ID NO: 427 - protein, 984 aa, Artificial Sequence
  CDH17#8 (hole) / CD3#7 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGGGGGSGGGGSGGGGSGGGGSQAVVTQEPSLTVSPGGTVTLTCRSSTGAVTTSNYANWVQQKPGQLPRGLIGGTNKRAPWVPARFSGSLLGGKAALTLSGAQPEDEAEYFCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 428 - protein, 984 aa, Artificial Sequence
  CDH17#8 (knob) / CD3#2 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNKWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 429 - protein, 984 aa, Artificial Sequence
  CDH17#8 (knob) / CD3#3 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEAVVTQEPSLTVSPGGTVTLTCRSSTGAVTTSNYANWVQQKPGQLPRGLIGGTNKRAPWVPARFSGSLLGGKAALTLSGAQPEDEAEYYCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 430 - protein, 984 aa, Artificial Sequence
  CDH17#8 (knob) / CD3#4 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGCGTKLTVLGGSEGKSSGSGSESKSTGGSEVQLVESGGGLVQPGGSLKLSCAASGFTFNTYAMNWVRQAPGKCLEWVARIRSKYNNYATYYADSVKDRFTISRDDSKNTAYLQMNNLKTEDTAVYYCVRHGNFGNSYVSWFAYWGQGTLVTVSA

SEQ ID NO: 431 - protein, 984 aa, Artificial Sequence
  CDH17#8 (knob) / CD3#5 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKGRFTISRDDSKNTAYLQMNNLKTEDTAVYYCVRHGNFGNSYVSWFAYWGQGTLVTVSA

SEQ ID NO: 432 - protein, 984 aa, Artificial Sequence
  CDH17#8 (knob) / CD3#6 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQAVVTQEPSLTVSPGGTVTLTCRSSTGAVTTSNYANWVQQKPGQLPRGLIGGTNKRAPGVPARFSGSLLGGKAALTLSGAQPEDEAEYYCALWYSNLWVFGCGTKLTVLGGSEGKSSGSGSESKSTGGSEVQLVESGGGLVQPGGSLKLSCAASGFTFNTYAMNWVRQAPGKCLEWVARIRSKYNNYATYYADSVKGRFTISRDDSKNTAYLQMNNLKTEDTAVYYCVRHGNFGNSYVSWFAYWGQGTLVTVSA

SEQ ID NO: 433 - protein, 984 aa, Artificial Sequence
  CDH17#8 (knob) / CD3#7 full length
EIVMTQSPATLSVSPGERATLSCRASQSVLYSSNQKQYLAWYQQKPGQAPRLLIYGASTRETGIPARFSGSGSGTEFTLTISSLQSEDFAVYYCQQYYSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLVQSGAEVKKPGSSVKVSCKASGYTFSDHTIHWVRQAPGQGLEWMGYIYPRLGSTKYAEKFQGRVTITADKSTSTAYMELSSLRSEDTAVYYCARWGYYYGSSRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQAVVTQEPSLTVSPGGTVTLTCRSSTGAVTTSNYANWVQQKPGQLPRGLIGGTNKRAPWVPARFSGSLLGGKAALTLSGAQPEDEAEYFCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

SEQ ID NO: 434 - protein, 329 aa, Artificial Sequence
  Fc domain knob
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 435 - protein, 329 aa, Artificial Sequence
  Fc domain hole
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 436 - protein, 702 aa, Artificial Sequence
  Trop2#11 full length (hole)
DIVLTQSPPSLAVSLGQRATISCRASESVDSSVNRFMHWYQQKPGQPPKLLIYRASNLESGIPARFSGSGSRTDFTLTINPVEADDVATYYCQQSNEDPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSDVQLQESGPGLVKPSQSLSLTCSVTGYSITSGYYWNWIRQFPGNKLEWMGYISYDGRNNYNPSLKNRISITRDTSENQFFLKLNSVTPEDTATYYCARDTTAYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 437 - protein, 984 aa, Artificial Sequence
  CDH17#1 (knob) / CD3#1 full length
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSEGKSSGSGSESKSTEGKSSGSGSESKSTGGGGSQVQLQQSDAELVKPGASVKISCKVSGYTFTDHTIHWMKQRPEQGLEWIGYIYPRDGSTKYNEKFKGKATLTADKSSSTAYMQLNSLTSEDSAVYFCARWGYYYGSSRYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEAVVTQEPSLTVSPGGTVTLTCRSSTGAVTTSNYANWVQEKPGQLPRGLIGGTNKRAPWVPARFSGSLLGGKAALTLSGAQPEDEAEYFCALWYSNLWVFGGGTKLTVLGGSEGKSSGSGSESKSTGGSEVQLVESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSA

The invention claimed is:

1. A binding molecule comprising:
    (a) at least one antigen binding site that binds specifically to trophoblast cell-surface antigen 2 (TROP2) wherein the at least one antigen binding site that binds specifically to TROP2 is selected from the group consisting of antigen binding sites (a-i) to (a-vi):
        (a-i) an antigen binding site comprising heavy chain CDRs comprising the amino acid sequences of SEQ ID NO.:1 (CDR1), SEQ ID NO.:2 (CDR2) and SEQ ID NO.:3 (CDR3) and light chain CDRs comprising the amino acid sequences of SEQ ID NO.:4 (CDR1), SEQ ID NO.:5 (CDR2) and SEQ ID NO.:6 (CDR3);
        (a-ii) an antigen binding site comprising heavy chain CDRs comprising the amino acid sequences of SEQ ID NO.:7 (CDR1), SEQ ID NO.:8 (CDR2) and SEQ ID NO.:9 (CDR3) and light chain CDRs comprising the amino acid sequences of SEQ ID NO.:10 (CDR1), SEQ ID NO.:11 (CDR2) and SEQ ID NO.:12 (CDR3);
        (a-iii) an antigen binding site comprising heavy chain CDRs comprising the amino acid sequences of SEQ ID NO.:13 (CDR1), SEQ ID NO.:14 (CDR2) and SEQ ID NO.:15 (CDR3) and light chain CDRs comprising the amino acid sequences of SEQ ID NO.:16 (CDR1), SEQ ID NO.:17 (CDR2) and SEQ ID NO.:18 (CDR3);
        (a-iv) an antigen binding site comprising heavy chain CDRs comprising the amino acid sequences of SEQ ID NO.:13 (CDR1), SEQ ID NO.:19 (CDR2) and SEQ ID NO.:15 (CDR3) and light chain CDRs comprising the amino acid sequences of SEQ ID NO.:20 (CDR1), SEQ ID NO.:17 (CDR2) and SEQ ID NO.:18 (CDR3);
        (a-v) an antigen binding site comprising heavy chain CDRs comprising the amino acid sequences of SEQ ID NO.:21 (CDR1), SEQ ID NO.:22 (CDR2) and SEQ ID NO.:23 (CDR3) and light chain CDRs comprising the amino acid sequences of SEQ ID NO.:24 (CDR1), SEQ ID NO.:25 (CDR2) and SEQ ID NO.:26 (CDR3);
        and
        (a-vi) an antigen binding site comprising heavy chain CDRs comprising the amino acid sequences of SEQ ID NO.:27 (CDR1), SEQ ID NO.:28 (CDR2) and SEQ ID NO.:29 (CDR3) and light chain CDRs comprising the amino acid sequences of SEQ ID NO.:30 (CDR1), SEQ ID NO.:25 (CDR2) and SEQ ID NO.:31 (CDR3),
    (b) at least one antigen binding site that binds specifically to cadherin-17 (CDH17), wherein the at least one antigen binding site that binds specifically to CDH17 is selected from the group consisting of antigen binding sites (b-i) to (b-ii):
        (b-i) an antigen binding site comprising heavy chain CDRs comprising the amino acid sequences of SEQ ID NO.:32 (CDR1), SEQ ID NO.:33 (CDR2) and SEQ ID NO.:34 (CDR3) and light chain CDRs comprising the amino acid sequences of SEQ ID NO.:35 (CDR1), SEQ ID NO.:36 (CDR2) and SEQ ID NO.:37 (CDR3);
        and
        (b-ii) an antigen binding site comprising heavy chain CDRs comprising the amino acid sequences of SEQ ID NO.:32 (CDR1), SEQ ID NO.:38 (CDR2) and SEQ ID NO.:34 (CDR3) and light chain CDRs comprising the amino acid sequences of SEQ ID NO.:39 (CDR1), SEQ ID NO.:40 (CDR2) and SEQ ID NO.:37 (CDR3), and
    (c) at least one antigen binding site that binds specifically to cluster of differentiation 3 (CD3).

2. The binding molecule of claim 1, wherein the at least one antigen binding site that binds specifically to TROP2 is selected from the group consisting of antigen binding sites (i) to (xii):
    (i) an antigen binding site comprising an immunoglobulin heavy chain variable domain comprising the amino acid sequence of SEQ ID NO:83 and an immunoglobulin light chain variable domain comprising the amino acid sequence of SEQ ID NO:84;
    (ii) an antigen binding site comprising an immunoglobulin heavy chain variable domain comprising the amino acid sequence of SEQ ID NO:85 and an immunoglobulin light chain variable domain comprising the amino acid sequence of SEQ ID NO:86;
(iii) an antigen binding site comprising an immunoglobulin heavy chain variable domain comprising the amino acid sequence of SEQ ID NO:87 and an immunoglobulin light chain variable domain comprising the amino acid sequence of SEQ ID NO:88;
(iv) an antigen binding site comprising an immunoglobulin heavy chain variable domain comprising the amino acid sequence of SEQ ID NO:89 and an immunoglobulin light chain variable domain comprising the amino acid sequence of SEQ ID NO:90;
(v) an antigen binding site comprising an immunoglobulin heavy chain variable domain comprising the amino acid sequence of SEQ ID NO:91 and an immunoglobulin light chain variable domain comprising the amino acid sequence of SEQ ID NO:92;
(vi) an antigen binding site comprising an immunoglobulin heavy chain variable domain comprising the amino acid sequence of SEQ ID NO:93 and an immunoglobulin light chain variable domain comprising the amino acid sequence of SEQ ID NO:94;
(vii) an antigen binding site comprising an immunoglobulin heavy chain variable domain comprising the amino acid sequence of SEQ ID NO:95 and an immunoglobulin light chain variable domain comprising the amino acid sequence of SEQ ID NO:94;
(viii) an antigen binding site comprising an immunoglobulin heavy chain variable domain comprising the amino acid sequence of SEQ ID NO:95 and an immunoglobulin light chain variable domain comprising the amino acid sequence of SEQ ID NO:96;
(ix) an antigen binding site comprising an immunoglobulin heavy chain variable domain comprising the amino acid sequence of SEQ ID NO:95 and an immunoglobulin light chain variable domain comprising the amino acid sequence of SEQ ID NO:97;
(x) an antigen binding site comprising an immunoglobulin heavy chain variable domain comprising the amino acid sequence of SEQ ID NO:98 and an immunoglobulin light chain variable domain comprising the amino acid sequence of SEQ ID NO:97;
(xi) an antigen binding site comprising an immunoglobulin heavy chain variable domain comprising the amino acid sequence of SEQ ID NO:95 and an immunoglobulin light chain variable domain comprising the amino acid sequence of SEQ ID NO:99;
or
(xii) an antigen binding site comprising an immunoglobulin heavy chain variable domain comprising the amino acid sequence of SEQ ID NO:98 and an immunoglobulin light chain variable domain comprising the amino acid sequence of SEQ ID NO:96.

3. The binding molecule of claim 1, wherein the at least one antigen binding site that binds specifically to CDH17 is selected from the group consisting of antigen binding sites (i) to (ii):
(i) an antigen binding site comprising an immunoglobulin heavy chain variable domain comprising the amino acid sequence of SEQ ID NO:100 and an immunoglobulin light chain variable domain comprising the amino acid sequence of SEQ ID NO:101; and
(ii) an antigen binding site comprising an immunoglobulin heavy chain variable domain comprising the amino acid sequence of SEQ ID NO:102 and an immunoglobulin light chain variable domain comprising the amino acid sequence of SEQ ID NO:103.

4. The binding molecule of claim 1, wherein the at least one antigen binding site that binds specifically to CD3 is selected from the group consisting of antigen binding sites (i) to (xxxi):
(i) an antigen binding site comprising heavy chain CDRs comprising the amino acid sequences of SEQ ID NO.: 41 (CDR1), SEQ ID NO.: 42 (CDR2) and SEQ ID NO.: 43 (CDR3) and light chain CDRs comprising the amino acid sequences of SEQ ID NO.: 44 (CDR1), SEQ ID NO.: 45 (CDR2) and SEQ ID NO.: 47 (CDR3);
(ii) an antigen binding site comprising heavy chain CDRs comprising the amino acid sequences of SEQ ID NO.: 41 (CDR1), SEQ ID NO.: 42 (CDR2) and SEQ ID NO.: 43 (CDR3) and light chain CDRs comprising the amino acid sequences of SEQ ID NO.: 44 (CDR1), SEQ ID NO.: 45 (CDR2) and SEQ ID NO.: 46 (CDR3);
(iii) an antigen binding site comprising heavy chain CDRs comprising the amino acid sequences of SEQ ID NO.: 41 (CDR1), SEQ ID NO.: 48 (CDR2) and SEQ ID NO.: 43 (CDR3) and light chain CDRs comprising the amino acid sequences of SEQ ID NO.: 44 (CDR1), SEQ ID NO.: 45 (CDR2) and SEQ ID NO.: 47 (CDR3);
(iv) an antigen binding site comprising heavy chain CDRs comprising the amino acid sequences of SEQ ID NO.: 41 (CDR1), SEQ ID NO.: 42 (CDR2) and SEQ ID NO.: 49 (CDR3) and light chain CDRs comprising the amino acid sequences of SEQ ID NO.: 50 (CDR1), SEQ ID NO.: 45 (CDR2) and SEQ ID NO.: 51 (CDR3);
(v) an antigen binding site comprising heavy chain CDRs comprising the amino acid sequences of SEQ ID NO.: 41 (CDR1), SEQ ID NO.: 42 (CDR2) and SEQ ID NO.: 43 (CDR3) and light chain CDRs comprising the amino acid sequences of SEQ ID NO.: 44 (CDR1), SEQ ID NO.: 52 (CDR2) and SEQ ID NO.: 47 (CDR3);
(vi) an antigen binding site comprising heavy chain CDRs comprising the amino acid sequences of SEQ ID NO.: 41 (CDR1), SEQ ID NO.: 42 (CDR2) and SEQ ID NO.: 49 (CDR3) and light chain CDRs comprising the amino acid sequences of SEQ ID NO.: 44 (CDR1), SEQ ID NO.: 52 (CDR2) and SEQ ID NO.: 47 (CDR3);
(vii) an antigen binding site comprising heavy chain CDRs comprising the amino acid sequences of SEQ ID NO.: 41 (CDR1), SEQ ID NO.: 42 (CDR2) and SEQ ID NO.: 43 (CDR3) and light chain CDRs comprising the amino acid sequences of SEQ ID NO.: 53 (CDR1), SEQ ID NO.: 52 (CDR2) and SEQ ID NO.: 47 (CDR3);
(viii) an antigen binding site comprising heavy chain CDRs comprising the amino acid sequences of SEQ ID NO.: 41 (CDR1), SEQ ID NO.: 48 (CDR2) and SEQ ID NO.: 54 (CDR3) and light chain CDRs comprising the amino acid sequences of SEQ ID NO.: 55 (CDR1), SEQ ID NO.: 45 (CDR2) and SEQ ID NO.: 51 (CDR3);
(ix) an antigen binding site comprising heavy chain CDRs comprising the amino acid sequences of SEQ ID NO.: 41 (CDR1), SEQ ID NO.: 48 (CDR2) and SEQ ID NO.: 54 (CDR3) and light chain CDRs comprising the amino acid sequences of SEQ ID NO.: 56 (CDR1), SEQ ID NO.: 52 (CDR2) and SEQ ID NO.: 51 (CDR3);
(x) an antigen binding site comprising heavy chain CDRs comprising the amino acid sequences of SEQ ID NO.: 41 (CDR1), SEQ ID NO.: 48 (CDR2) and SEQ ID NO.: 54 (CDR3) and light chain CDRs comprising the amino acid sequences of SEQ ID NO.: 57 (CDR1), SEQ ID NO.: 45 (CDR2) and SEQ ID NO.: 51 (CDR3);

(xi) an antigen binding site comprising heavy chain CDRs comprising the amino acid sequences of SEQ ID NO.: 41 (CDR1), SEQ ID NO.: 58 (CDR2) and SEQ ID NO.: 59 (CDR3) and light chain CDRs comprising the amino acid sequences of SEQ ID NO.: 60 (CDR1), SEQ ID NO.: 45 (CDR2) and SEQ ID NO.: 51 (CDR3);

(xii) an antigen binding site comprising heavy chain CDRs comprising the amino acid sequences of SEQ ID NO.: 41 (CDR1), SEQ ID NO.: 42 (CDR2) and SEQ ID NO.: 43 (CDR3) and light chain CDRs comprising the amino acid sequences of SEQ ID NO.: 61 (CDR1), SEQ ID NO.: 52 (CDR2) and SEQ ID NO.: 51 (CDR3);

(xiii) an antigen binding site comprising heavy chain CDRs comprising the amino acid sequences of SEQ ID NO.: 41 (CDR1), SEQ ID NO.: 62 (CDR2) and SEQ ID NO.: 54 (CDR3) and light chain CDRs comprising the amino acid sequences of SEQ ID NO.: 57 (CDR1), SEQ ID NO.: 45 (CDR2) and SEQ ID NO.: 51 (CDR3);

(xiv) an antigen binding site comprising heavy chain CDRs comprising the amino acid sequences of SEQ ID NO.: 41 (CDR1), SEQ ID NO.: 63 (CDR2) and SEQ ID NO.: 54 (CDR3) and light chain CDRs comprising the amino acid sequences of SEQ ID NO.: 56 (CDR1), SEQ ID NO.: 45 (CDR2) and SEQ ID NO.: 51 (CDR3);

(xv) an antigen binding site comprising heavy chain CDRs comprising the amino acid sequences of SEQ ID NO.: 41 (CDR1), SEQ ID NO.: 42 (CDR2) and SEQ ID NO.: 43 (CDR3) and light chain CDRs comprising the amino acid sequences of SEQ ID NO.: 61 (CDR1), SEQ ID NO.: 45 (CDR2) and SEQ ID NO.: 51 (CDR3);

(xvi) an antigen binding site comprising heavy chain CDRs comprising the amino acid sequences of SEQ ID NO.: 41 (CDR1), SEQ ID NO.: 42 (CDR2) and SEQ ID NO.: 43 (CDR3) and light chain CDRs comprising the amino acid sequences of SEQ ID NO.: 57 (CDR1), SEQ ID NO.: 52 (CDR2) and SEQ ID NO.: 51 (CDR3);

(xvii) an antigen binding site comprising heavy chain CDRs comprising the amino acid sequences of SEQ ID NO.: 82 (CDR1), SEQ ID NO.: 64 (CDR2) and SEQ ID NO.: 65 (CDR3) and light chain CDRs comprising the amino acid sequences of SEQ ID NO.: 66 (CDR1), SEQ ID NO.: 67 (CDR2) and SEQ ID NO.: 68 (CDR3);

(xviii) an antigen binding site comprising heavy chain CDRs comprising the amino acid sequences of SEQ ID NO.: 82 (CDR1), SEQ ID NO.: 69 (CDR2) and SEQ ID NO.: 70 (CDR3) and light chain CDRs comprising the amino acid sequences of SEQ ID NO.: 66 (CDR1), SEQ ID NO.: 67 (CDR2) and SEQ ID NO.: 68 (CDR3);

(xix) an antigen binding site comprising heavy chain CDRs comprising the amino acid sequences of SEQ ID NO.: 82 (CDR1), SEQ ID NO.: 72 (CDR2) and SEQ ID NO.: 65 (CDR3) and light chain CDRs comprising the amino acid sequences of SEQ ID NO.: 66 (CDR1), SEQ ID NO.: 67 (CDR2) and SEQ ID NO.: 68 (CDR3);

(xx) an antigen binding site comprising heavy chain CDRs comprising the amino acid sequences of SEQ ID NO.: 82 (CDR1), SEQ ID NO.: 73 (CDR2) and SEQ ID NO.: 65 (CDR3) and light chain CDRs comprising the amino acid sequences of SEQ ID NO.: 66 (CDR1), SEQ ID NO.: 67 (CDR2) and SEQ ID NO.: 68 (CDR3);

(xxi) an antigen binding site comprising heavy chain CDRs comprising the amino acid sequences of SEQ ID NO.: 82 (CDR1), SEQ ID NO.: 74 (CDR2) and SEQ ID NO.: 65 (CDR3) and light chain CDRs comprising the amino acid sequences of SEQ ID NO.: 71 (CDR1), SEQ ID NO.: 67 (CDR2) and SEQ ID NO.: 68 (CDR3);

(xxii) an antigen binding site comprising heavy chain CDRs comprising the amino acid sequences of SEQ ID NO.: 82 (CDR1), SEQ ID NO.: 73 (CDR2) and SEQ ID NO.: 70 (CDR3) and light chain CDRs comprising the amino acid sequences of SEQ ID NO.: 71 (CDR1), SEQ ID NO.: 67 (CDR2) and SEQ ID NO.: 68 (CDR3);

(xxiii) an antigen binding site comprising heavy chain CDRs comprising the amino acid sequences of SEQ ID NO.: 82 (CDR1), SEQ ID NO.: 75 (CDR2) and SEQ ID NO.: 65 (CDR3) and light chain CDRs comprising the amino acid sequences of SEQ ID NO.: 66 (CDR1), SEQ ID NO.: 67 (CDR2) and SEQ ID NO.: 68 (CDR3);

(xxiv) an antigen binding site comprising heavy chain CDRs comprising the amino acid sequences of SEQ ID NO.: 82 (CDR1), SEQ ID NO.: 69 (CDR2) and SEQ ID NO.: 65 (CDR3) and light chain CDRs comprising the amino acid sequences of SEQ ID NO.: 71 (CDR1), SEQ ID NO.: 67 (CDR2) and SEQ ID NO.: 68 (CDR3);

(xxv) an antigen binding site comprising heavy chain CDRs comprising the amino acid sequences of SEQ ID NO.: 82 (CDR1), SEQ ID NO.: 76 (CDR2) and SEQ ID NO.: 65 (CDR3) and light chain CDRs comprising the amino acid sequences of SEQ ID NO.: 66 (CDR1), SEQ ID NO.: 67 (CDR2) and SEQ ID NO.: 68 (CDR3);

(xxvi) an antigen binding site comprising heavy chain CDRs comprising the amino acid sequences of SEQ ID NO.: 82 (CDR1), SEQ ID NO.: 77 (CDR2) and SEQ ID NO.: 65 (CDR3) and light chain CDRs comprising the amino acid sequences of SEQ ID NO.: 71 (CDR1), SEQ ID NO.: 67 (CDR2) and SEQ ID NO.: 68 (CDR3);

(xxvii) an antigen binding site comprising heavy chain CDRs comprising the amino acid sequences of SEQ ID NO.: 82 (CDR1), SEQ ID NO.: 78 (CDR2) and SEQ ID NO.: 65 (CDR3) and light chain CDRs comprising the amino acid sequences of SEQ ID NO.: 66 (CDR1), SEQ ID NO.: 67 (CDR2) and SEQ ID NO.: 68 (CDR3);

(xxviii) an antigen binding site comprising heavy chain CDRs comprising the amino acid sequences of SEQ ID NO.: 82 (CDR1), SEQ ID NO.: 79 (CDR2) and SEQ ID NO.: 65 (CDR3) and light chain CDRs comprising the amino acid sequences of SEQ ID NO.: 80 (CDR1), SEQ ID NO.: 67 (CDR2) and SEQ ID NO.: 68 (CDR3);

(xxix) an antigen binding site comprising heavy chain CDRs comprising the amino acid sequences of SEQ ID NO.: 82 (CDR1), SEQ ID NO.: 81 (CDR2) and SEQ ID NO.: 70 (CDR3) and light chain CDRs comprising the amino acid sequences of SEQ ID NO.: 66 (CDR1), SEQ ID NO.: 67 (CDR2) and SEQ ID NO.: 68 (CDR3);

(xxx) an antigen binding site comprising heavy chain CDRs comprising the amino acid sequences of SEQ ID NO.: 82 (CDR1), SEQ ID NO.: 79 (CDR2) and SEQ ID NO.: 65 (CDR3) and light chain CDRs comprising the amino acid sequences of SEQ ID NO.: 80 (CDR1), SEQ ID NO.: 67 (CDR2) and SEQ ID NO.: 68 (CDR3); and (xxxi) an antigen binding site comprising heavy chain CDRs comprising the amino acid sequences of SEQ ID NO.: 82 (CDR1), SEQ ID NO.: 81 (CDR2) and SEQ ID NO.: 70 (CDR3) and light chain CDRs comprising the amino acid sequences of SEQ ID NO.: 66 (CDR1), SEQ ID NO.: 67 (CDR2) and SEQ ID NO.: 68 (CDR3).

5. The binding molecule of claim 1, wherein the at least one antigen binding site that binds specifically to CD3 is selected from the group consisting of antigen binding sites (i) to (xvi):

(i) an antigen binding site comprising an immunoglobulin heavy chain variable domain comprising the amino acid sequence of SEQ ID NO:104 and an immunoglobulin light chain variable domain comprising an amino acid sequence selected from the group consisting of SEQ ID NO:105, SEQ ID NO: 106, SEQ ID NO: 107, SEQ ID NO: 109, SEQ ID NO: 114, SEQ ID NO:115, SEQ ID NO:116, SEQ ID NO:117, SEQ ID NO: 120, SEQ ID NO: 121, SEQ ID NO: 123, and SEQ ID NO:129;

(ii) an antigen binding site comprising an immunoglobulin heavy chain variable domain comprising the amino acid sequence of SEQ ID NO:110 and an immunoglobulin light chain variable domain comprising the amino acid sequence of SEQ ID NO:111;

(iii) an antigen binding site comprising an immunoglobulin heavy chain variable domain comprising the amino acid sequence of SEQ ID NO:112 and an immunoglobulin light chain variable domain comprising the amino acid sequence of SEQ ID NO:113;

(iv) an antigen binding site comprising an immunoglobulin heavy chain variable domain comprising the amino acid sequence of SEQ ID NO:118 and an immunoglobulin light chain variable domain comprising an amino acid sequence selected from the group consisting of SEQ ID NO: 119 and SEQ ID NO: 122;

(v) an antigen binding site comprising an immunoglobulin heavy chain variable domain comprising the amino acid sequence of SEQ ID NO:124 and an immunoglobulin light chain variable domain comprising an amino acid sequence selected from the group consisting of SEQ ID NO:125, SEQ ID NO: 126 and SEQ ID NO: 127;

(v) an antigen binding site comprising an immunoglobulin heavy chain variable domain comprising an amino acid sequence selected from the group consisting of SEQ ID NO: 128 and SEQ ID NO:130 and an immunoglobulin light chain variable domain comprising an amino acid sequence of SEQ ID NO:127;

(vi) an antigen binding site comprising an immunoglobulin heavy chain variable domain comprising the amino acid sequence of SEQ ID NO:131 and an immunoglobulin light chain variable domain comprising the amino acid sequence of SEQ ID NO: 132;

(vii) an antigen binding site comprising an immunoglobulin heavy chain variable domain comprising the amino acid sequence of SEQ ID NO:133 and an immunoglobulin light chain variable domain comprising an amino acid sequence selected from the group consisting of SEQ ID NO: 134 and SEQ ID NO: 135;

(viii) an antigen binding site comprising an immunoglobulin heavy chain variable domain comprising the amino acid sequence of SEQ ID NO:136 and an immunoglobulin light chain variable domain comprising the amino acid sequence of SEQ ID NO:137;

(ix) an antigen binding site comprising an immunoglobulin heavy chain variable domain comprising an amino acid sequence selected from the group consisting of SEQ ID NO:138 and SEQ ID NO: 156 and an immunoglobulin light chain variable domain comprising the amino acid sequence of SEQ ID NO:139;

(x) an antigen binding site comprising an immunoglobulin heavy chain variable domain comprising an amino acid sequence selected from the group consisting of SEQ ID NO: 140, SEQ ID NO: 142, SEQ ID NO: 143 and SEQ ID NO: 161 and an immunoglobulin light chain variable domain comprising an amino acid sequence of SEQ ID NO: 141;

(xi) an antigen binding site comprising an immunoglobulin heavy chain variable domain comprising an amino acid sequence selected from the group consisting of SEQ ID NO:144 and SEQ ID NO: 146 and an immunoglobulin light chain variable domain comprising an amino acid sequence of SEQ ID NO:145;

(xii) an antigen binding site comprising an immunoglobulin heavy chain variable domain comprising an amino acid sequence selected from the group consisting of SEQ ID NO: 147, SEQ ID NO: 151, SEQ ID NO: 153 and SEQ ID NO: 162 and an immunoglobulin light chain variable domain comprising an amino acid sequence of SEQ ID NO:148;

(xiii) an antigen binding site comprising an immunoglobulin heavy chain variable domain comprising an amino acid sequence selected from the group consisting of SEQ ID NO: 149 and SEQ ID NO: 152 and an immunoglobulin light chain variable domain comprising an amino acid sequence of SEQ ID NO:150;

(xiv) an antigen binding site comprising an immunoglobulin heavy chain variable domain comprising the amino acid sequence of SEQ ID NO:154 and an immunoglobulin light chain variable domain comprising the amino acid sequence of SEQ ID NO:155;

(xv) an antigen binding site comprising an immunoglobulin heavy chain variable domain comprising the amino acid sequence of SEQ ID NO:157 and an immunoglobulin light chain variable domain comprising the amino acid sequence of SEQ ID NO: 158; and (xvi) an antigen binding site comprising an immunoglobulin heavy chain variable domain comprising the amino acid sequence of SEQ ID NO:159 and an immunoglobulin light chain variable domain comprising the amino acid sequence of SEQ ID NO:160.

6. The binding molecule of claim 1, wherein the binding molecule is a modified IgG molecule, wherein said at least one antigen binding site that specifically binds to TROP2 and said at least one antigen binding site that specifically binds to CDH17 reside in the variable regions of said IgG molecule, and wherein said at least one antigen binding site that binds specifically to CD3 is a scFv fused to said TROP2-CDH17-specific IgG molecule.

7. The binding molecule of claim 6, wherein the scFv is fused to the C-terminus of the heavy chain of the IgG molecule.

8. The binding molecule of claim 1, wherein the binding molecule comprises:

(a) a first immunoglobulin light chain and immunoglobulin heavy chain combination selected from (a-i) to (a-xii), linked together by a peptide linker:

(a-i) an immunoglobulin light chain comprising the amino acid sequence of SEQ ID NO:169 and an immunoglobulin heavy chain comprising the amino acid sequence of SEQ ID NO:170;

(a-ii) an immunoglobulin light chain comprising the amino acid sequence of SEQ ID NO:171 and an immunoglobulin heavy chain comprising the amino acid sequence of SEQ ID NO: 172;

(a-iii) an immunoglobulin light chain comprising the amino acid sequence of SEQ ID NO:173 and an immunoglobulin heavy chain comprising the amino acid sequence of SEQ ID NO:174;

(a-iv) an immunoglobulin light chain comprising the amino acid sequence of SEQ ID NO:175 and an immunoglobulin heavy chain comprising the amino acid sequence of SEQ ID NO:176;

(a-v) an immunoglobulin light chain comprising the amino acid sequence of SEQ ID NO:177 and an immunoglobulin heavy chain comprising the amino acid sequence of SEQ ID NO:178;
(a-vi) an immunoglobulin light chain comprising the amino acid sequence of SEQ ID NO:179 and an immunoglobulin heavy chain comprising the amino acid sequence of SEQ ID NO:180;
(a-vii) an immunoglobulin light chain comprising the amino acid sequence of SEQ ID NO:181 and an immunoglobulin heavy chain comprising the amino acid sequence of SEQ ID NO:182;
(a-viii) an immunoglobulin light chain comprising the amino acid sequence of SEQ ID NO:183 and an immunoglobulin heavy chain comprising the amino acid sequence of SEQ ID NO:184;
(a-ix) an immunoglobulin light chain comprising the amino acid sequence of SEQ ID NO:185 and an immunoglobulin heavy chain comprising the amino acid sequence of SEQ ID NO: 186;
(a-x) an immunoglobulin light chain comprising the amino acid sequence of SEQ ID NO:187 and an immunoglobulin heavy chain comprising the amino acid sequence of SEQ ID NO: 188;
(a-xi) an immunoglobulin light chain comprising the amino acid sequence of SEQ ID NO:189 and an immunoglobulin heavy chain comprising the amino acid sequence of SEQ ID NO: 190; or
(a-xii) an immunoglobulin light chain comprising the amino acid sequence of SEQ ID NO:191 and an immunoglobulin heavy chain comprising the amino acid sequence of SEQ ID NO:192;
and
(b) a second immunoglobulin heavy chain and immunoglobulin light chain combination selected from (b-i) to (b-ii), linked together by a peptide-linker:
(b-i) an immunoglobulin light chain comprising the amino acid sequence of SEQ ID NO:196 and an immunoglobulin heavy chain comprising the amino acid sequence of SEQ ID NO: 197; or
(b-ii) an immunoglobulin heavy chain comprising the amino acid sequence of SEQ ID NO: 198 and an immunoglobulin light chain comprising the amino acid sequence of SEQ ID NO: 199;
and
(c) a single-chain variable fragment (scFv) comprising an amino acid sequence selected from the group consisting of SEQ ID NOs: 222 to 264, linked to the C-terminus of the immunoglobulin heavy chain of said second immunoglobulin heavy chain and immunoglobulin light chain combination.

9. The binding molecule of claim 1, wherein the binding molecule comprises or consists of:
(a-i) the amino acid sequence of SEQ ID NO.: 200 and the amino acid sequence of SEQ ID NO.: 267;
(a-ii) the amino acid sequence of SEQ ID NO.: 207 and the amino acid sequence of SEQ ID NO.: 267;
(a-iii) the amino acid sequence of SEQ ID NO.: 208 and the amino acid sequence of SEQ ID NO.: 267;
(a-iv) the amino acid sequence of SEQ ID NO.: 209 and the amino acid sequence of SEQ ID NO.: 267;
(a-v) the amino acid sequence of SEQ ID NO.: 210 and the amino acid sequence of SEQ ID NO.: 267;
(a-vi) the amino acid sequence of SEQ ID NO.: 211 and the amino acid sequence of SEQ ID NO.: 267;
(a-vii) the amino acid sequence of SEQ ID NO.: 212 and the amino acid sequence of SEQ ID NO.: 267;
(a-viii) the amino acid sequence of SEQ ID NO.: 213 and the amino acid sequence of SEQ ID NO.: 267;
(a-ix) the amino acid sequence of SEQ ID NO.: 214 and the amino acid sequence of SEQ ID NO.: 267;
(a-x) the amino acid sequence of SEQ ID NO.: 215 and the amino acid sequence of SEQ ID NO.: 267;
(a-xi) the amino acid sequence of SEQ ID NO.: 216 and the amino acid sequence of SEQ ID NO.: 267;
(a-xii) the amino acid sequence of SEQ ID NO.: 217 and the amino acid sequence of SEQ ID NO.: 267;
(b-i) the amino acid sequence of SEQ ID NO.: 200 and the amino acid sequence of SEQ ID NO.: 268;
(b-ii) the amino acid sequence of SEQ ID NO.: 207 and the amino acid sequence of SEQ ID NO.: 268;
(b-iii) the amino acid sequence of SEQ ID NO.: 208 and the amino acid sequence of SEQ ID NO.: 268;
(b-iv) the amino acid sequence of SEQ ID NO.: 209 and the amino acid sequence of SEQ ID NO.: 268;
(b-v) the amino acid sequence of SEQ ID NO.: 210 and the amino acid sequence of SEQ ID NO.: 268;
(b-vi) the amino acid sequence of SEQ ID NO.: 211 and the amino acid sequence of SEQ ID NO.: 268;
(b-vii) the amino acid sequence of SEQ ID NO.: 212 and the amino acid sequence of SEQ ID NO.: 268;
(b-viii) the amino acid sequence of SEQ ID NO.: 213 and the amino acid sequence of SEQ ID NO.: 268;
(b-ix) the amino acid sequence of SEQ ID NO.: 214 and the amino acid sequence of SEQ ID NO.: 268;
(b-x) the amino acid sequence of SEQ ID NO.: 215 and the amino acid sequence of SEQ ID NO.: 268;
(b-xi) the amino acid sequence of SEQ ID NO.: 216 and the amino acid sequence of SEQ ID NO.: 268;
(b-xii) the amino acid sequence of SEQ ID NO.: 217 and the amino acid sequence of SEQ ID NO.: 268;
(c-i) the amino acid sequence of SEQ ID NO.: 200 and the amino acid sequence of SEQ ID NO.: 269;
(c-ii) the amino acid sequence of SEQ ID NO.: 207 and the amino acid sequence of SEQ ID NO.: 269;
(c-iii) the amino acid sequence of SEQ ID NO.: 208 and the amino acid sequence of SEQ ID NO.: 269;
(c-iv) the amino acid sequence of SEQ ID NO.: 209 and the amino acid sequence of SEQ ID NO.: 269;
(c-v) the amino acid sequence of SEQ ID NO.: 210 and the amino acid sequence of SEQ ID NO.: 269;
(c-vi) the amino acid sequence of SEQ ID NO.: 211 and the amino acid sequence of SEQ ID NO.: 269;
(c-vii) the amino acid sequence of SEQ ID NO.: 212 and the amino acid sequence of SEQ ID NO.: 269;
(c-viii) the amino acid sequence of SEQ ID NO.: 213 and the amino acid sequence of SEQ ID NO.: 269;
(c-ix) the amino acid sequence of SEQ ID NO.: 214 and the amino acid sequence of SEQ ID NO.: 269;
(c-x) the amino acid sequence of SEQ ID NO.: 215 and the amino acid sequence of SEQ ID NO.: 269;
(c-xi) the amino acid sequence of SEQ ID NO.: 216 and the amino acid sequence of SEQ ID NO.: 269;
(c-xii) the amino acid sequence of SEQ ID NO.: 217 and the amino acid sequence of SEQ ID NO.: 269;
(d-i) the amino acid sequence of SEQ ID NO.: 200 and the amino acid sequence of SEQ ID NO.: 270;
(d-ii) the amino acid sequence of SEQ ID NO.: 207 and the amino acid sequence of SEQ ID NO.: 270;
(d-iii) the amino acid sequence of SEQ ID NO.: 208 and the amino acid sequence of SEQ ID NO.: 270;
(d-iv) the amino acid sequence of SEQ ID NO.: 209 and the amino acid sequence of SEQ ID NO.: 270;

(d-v) the amino acid sequence of SEQ ID NO.: 210 and the amino acid sequence of SEQ ID NO.: 270;
(d-vi) the amino acid sequence of SEQ ID NO.: 211 and the amino acid sequence of SEQ ID NO.: 270;
(d-vii) the amino acid sequence of SEQ ID NO.: 212 and the amino acid sequence of SEQ ID NO.: 270;
(d-viii) the amino acid sequence of SEQ ID NO.: 213 and the amino acid sequence of SEQ ID NO.: 270;
(d-ix) the amino acid sequence of SEQ ID NO.: 214 and the amino acid sequence of SEQ ID NO.: 270;
(d-x) the amino acid sequence of SEQ ID NO.: 215 and the amino acid sequence of SEQ ID NO.: 270;
(d-xi) the amino acid sequence of SEQ ID NO.: 216 and the amino acid sequence of SEQ ID NO.: 270;
(d-xii) the amino acid sequence of SEQ ID NO.: 217 and the amino acid sequence of SEQ ID NO.: 270;
(e-i) the amino acid sequence of SEQ ID NO.: 200 and the amino acid sequence of SEQ ID NO.: 271;
(e-ii) the amino acid sequence of SEQ ID NO.: 207 and the amino acid sequence of SEQ ID NO.: 271;
(e-iii) the amino acid sequence of SEQ ID NO.: 208 and the amino acid sequence of SEQ ID NO.: 271;
(e-iv) the amino acid sequence of SEQ ID NO.: 209 and the amino acid sequence of SEQ ID NO.: 271;
(e-v) the amino acid sequence of SEQ ID NO.: 210 and the amino acid sequence of SEQ ID NO.: 271;
(e-vi) the amino acid sequence of SEQ ID NO.: 211 and the amino acid sequence of SEQ ID NO.: 271;
(e-vii) the amino acid sequence of SEQ ID NO.: 212 and the amino acid sequence of SEQ ID NO.: 271;
(e-viii) the amino acid sequence of SEQ ID NO.: 213 and the amino acid sequence of SEQ ID NO.: 271;
(e-ix) the amino acid sequence of SEQ ID NO.: 214 and the amino acid sequence of SEQ ID NO.: 271;
(e-x) the amino acid sequence of SEQ ID NO.: 215 and the amino acid sequence of SEQ ID NO.: 271;
(e-xi) the amino acid sequence of SEQ ID NO.: 216 and the amino acid sequence of SEQ ID NO.: 271;
(e-xii) the amino acid sequence of SEQ ID NO.: 217 and the amino acid sequence of SEQ ID NO.: 271;
(f-i) the amino acid sequence of SEQ ID NO.: 200 and the amino acid sequence of SEQ ID NO.: 272;
(f-ii) the amino acid sequence of SEQ ID NO.: 207 and the amino acid sequence of SEQ ID NO.: 272;
(f-iii) the amino acid sequence of SEQ ID NO.: 208 and the amino acid sequence of SEQ ID NO.: 272;
(f-iv) the amino acid sequence of SEQ ID NO.: 209 and the amino acid sequence of SEQ ID NO.: 272;
(f-v) the amino acid sequence of SEQ ID NO.: 210 and the amino acid sequence of SEQ ID NO.: 272;
(f-vi) the amino acid sequence of SEQ ID NO.: 211 and the amino acid sequence of SEQ ID NO.: 272;
(f-vii) the amino acid sequence of SEQ ID NO.: 212 and the amino acid sequence of SEQ ID NO.: 272;
(f-viii) the amino acid sequence of SEQ ID NO.: 213 and the amino acid sequence of SEQ ID NO.: 272;
(f-ix) the amino acid sequence of SEQ ID NO.: 214 and the amino acid sequence of SEQ ID NO.: 272;
(f-x) the amino acid sequence of SEQ ID NO.: 215 and the amino acid sequence of SEQ ID NO.: 272;
(f-xi) the amino acid sequence of SEQ ID NO.: 216 and the amino acid sequence of SEQ ID NO.: 272;
(f-xii) the amino acid sequence of SEQ ID NO.: 217 and the amino acid sequence of SEQ ID NO.: 272;
(g-i) the amino acid sequence of SEQ ID NO.: 200 and the amino acid sequence of SEQ ID NO.: 424;
(g-ii) the amino acid sequence of SEQ ID NO.: 207 and the amino acid sequence of SEQ ID NO.: 424;
(g-iii) the amino acid sequence of SEQ ID NO.: 208 and the amino acid sequence of SEQ ID NO.: 424;
(g-iv) the amino acid sequence of SEQ ID NO.: 209 and the amino acid sequence of SEQ ID NO.: 424;
(g-v) the amino acid sequence of SEQ ID NO.: 210 and the amino acid sequence of SEQ ID NO.: 424;
(g-vi) the amino acid sequence of SEQ ID NO.: 211 and the amino acid sequence of SEQ ID NO.: 424;
(g-vii) the amino acid sequence of SEQ ID NO.: 212 and the amino acid sequence of SEQ ID NO.: 424;
(g-viii) the amino acid sequence of SEQ ID NO.: 213 and the amino acid sequence of SEQ ID NO.: 424;
(g-ix) the amino acid sequence of SEQ ID NO.: 214 and the amino acid sequence of SEQ ID NO.: 424;
(g-x) the amino acid sequence of SEQ ID NO.: 215 and the amino acid sequence of SEQ ID NO.: 424;
(g-xi) the amino acid sequence of SEQ ID NO.: 216 and the amino acid sequence of SEQ ID NO.: 424;
(g-xii) the amino acid sequence of SEQ ID NO.: 217 and the amino acid sequence of SEQ ID NO.: 424;
(h-i) the amino acid sequence of SEQ ID NO.: 200 and the amino acid sequence of SEQ ID NO.: 425;
(h-ii) the amino acid sequence of SEQ ID NO.: 207 and the amino acid sequence of SEQ ID NO.: 425;
(h-iii) the amino acid sequence of SEQ ID NO.: 208 and the amino acid sequence of SEQ ID NO.: 425;
(h-iv) the amino acid sequence of SEQ ID NO.: 209 and the amino acid sequence of SEQ ID NO.: 425;
(h-v) the amino acid sequence of SEQ ID NO.: 210 and the amino acid sequence of SEQ ID NO.: 425;
(h-vi) the amino acid sequence of SEQ ID NO.: 211 and the amino acid sequence of SEQ ID NO.: 425;
(h-vii) the amino acid sequence of SEQ ID NO.: 212 and the amino acid sequence of SEQ ID NO.: 425;
(h-viii) the amino acid sequence of SEQ ID NO.: 213 and the amino acid sequence of SEQ ID NO.: 425;
(h-ix) the amino acid sequence of SEQ ID NO.: 214 and the amino acid sequence of SEQ ID NO.: 425;
(h-x) the amino acid sequence of SEQ ID NO.: 215 and the amino acid sequence of SEQ ID NO.: 425;
(h-xi) the amino acid sequence of SEQ ID NO.: 216 and the amino acid sequence of SEQ ID NO.: 425;
(h-xii) the amino acid sequence of SEQ ID NO.: 217 and the amino acid sequence of SEQ ID NO.: 425;
(i-i) the amino acid sequence of SEQ ID NO.: 200 and the amino acid sequence of SEQ ID NO.: 426;
(i-ii) the amino acid sequence of SEQ ID NO.: 207 and the amino acid sequence of SEQ ID NO.: 426;
(i-iii) the amino acid sequence of SEQ ID NO.: 208 and the amino acid sequence of SEQ ID NO.: 426;
(i-iv) the amino acid sequence of SEQ ID NO.: 209 and the amino acid sequence of SEQ ID NO.: 426;
(i-v) the amino acid sequence of SEQ ID NO.: 210 and the amino acid sequence of SEQ ID NO.: 426;
(i-vi) the amino acid sequence of SEQ ID NO.: 211 and the amino acid sequence of SEQ ID NO.: 426;
(i-vii) the amino acid sequence of SEQ ID NO.: 212 and the amino acid sequence of SEQ ID NO.: 426;
(i-viii) the amino acid sequence of SEQ ID NO.: 213 and the amino acid sequence of SEQ ID NO.: 426;
(i-ix) the amino acid sequence of SEQ ID NO.: 214 and the amino acid sequence of SEQ ID NO.: 426;
(i-x) the amino acid sequence of SEQ ID NO.: 215 and the amino acid sequence of SEQ ID NO.: 426;

(i-xi) the amino acid sequence of SEQ ID NO.: 216 and the amino acid sequence of SEQ ID NO.: 426;
(i-xii) the amino acid sequence of SEQ ID NO.: 217 and the amino acid sequence of SEQ ID NO.: 426;
(j-i) the amino acid sequence of SEQ ID NO.: 200 and the amino acid sequence of SEQ ID NO.: 427;
(j-ii) the amino acid sequence of SEQ ID NO.: 207 and the amino acid sequence of SEQ ID NO.: 427;
(j-iii) the amino acid sequence of SEQ ID NO.: 208 and the amino acid sequence of SEQ ID NO.: 427;
(j-iv) the amino acid sequence of SEQ ID NO.: 209 and the amino acid sequence of SEQ ID NO.: 427;
(j-v) the amino acid sequence of SEQ ID NO.: 210 and the amino acid sequence of SEQ ID NO.: 427;
(j-vi) the amino acid sequence of SEQ ID NO.: 211 and the amino acid sequence of SEQ ID NO.: 427;
(j-vii) the amino acid sequence of SEQ ID NO.: 212 and the amino acid sequence of SEQ ID NO.: 427;
(j-viii) the amino acid sequence of SEQ ID NO.: 213 and the amino acid sequence of SEQ ID NO.: 427;
(j-ix) the amino acid sequence of SEQ ID NO.: 214 and the amino acid sequence of SEQ ID NO.: 427;
(j-x) the amino acid sequence of SEQ ID NO.: 215 and the amino acid sequence of SEQ ID NO.: 427;
(j-xi) the amino acid sequence of SEQ ID NO.: 216 and the amino acid sequence of SEQ ID NO.: 427;
(j-xii) the amino acid sequence of SEQ ID NO.: 217 and the amino acid sequence of SEQ ID NO.: 427; or
(k) the amino acid sequence of SEQ ID NO.: 436 and the amino acid sequence of SEQ ID NO.: 437.

10. A nucleic acid molecule encoding the binding molecule of claim 1, or a part thereof.

11. An expression vector comprising one or more nucleic acid molecule(s) of claim 10.

12. A host cell transfected with the expression vector of claim 11.

13. A method of producing the binding molecule of claim 1, the method comprising the steps:
  (a) culturing a host cell transfected with an expression vector comprising one or more nucleic acid molecule(s) encoding the binding molecule of claim 1 under conditions allowing expression of said binding molecule
  (b) recovering said molecule.

14. A pharmaceutical composition comprising or consisting of one or more binding molecules of claim 1 and a pharmaceutically acceptable carrier.

15. A method of treating or ameliorating cancers that express TROP2 and/or CDH17 comprising administering a therapeutically effective amount of the binding molecule of claim 1, to a patient in need thereof.

16. The method according to claim 15, wherein the cancer is colorectal cancer (CRC), gastric cancer (GC) or pancreatic cancer (PAC).

17. The method according to claim 15, wherein the binding molecule is to be used in combination with an immune checkpoint inhibitor.

* * * * *